United States Patent 11,241,493 (CORONAVIRUS VACCINE) - sequence listing, part 9

SEQ ID NO: 12392 - RNA, 3998 nt, Artificial Sequence
  SARS-CoV-2/Wuhan/WIV05/2019__EPI_ISL_402128 spike protein mRNA gc (1-1211)(I909C_Y1047C) Foldon construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcugcggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaaggggugccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccugugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12393 - RNA, 3998 nt, Artificial Sequence
  SARS-CoV-2/Wuhan/WIV05/2019__EPI_ISL_402128 spike protein mRNA gc (1-1211)(Q965C_S1003C) Foldon construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagugccuguccagcaacuucggcgccaucuccagcgugcugaacgacauccucucccgccuggacaaggucgaggccgaggugcagaucgaccggcugaucaccgggcgccuccagugccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccugugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12394 - RNA, 3998 nt, Artificial Sequence
  SARS-CoV-2/Wuhan/WIV05/2019__EPI_ISL_402128 spike protein mRNA gc (1-1211)(F970C_G999C) Foldon construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacugcggcgccaucuccagcgugcugaacgacauccucucccgccuggacaaggucgaggccgaggugcagaucgaccggcugaucaccugucgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccugugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12395 - RNA, 3998 nt, Artificial Sequence
  SARS-CoV-2/Wuhan/WIV05/2019__EPI_ISL_402128 spike protein mRNA gc (1-1211)(A972C_R995C) Foldon construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcugcaucuccagcgugcugaacgacauccucucccgccuggacaaggucgaggccgaggugcagaucgacugccugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccugugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12396 - RNA, 3998 nt, Artificial Sequence
  SARS-CoV-2/Wuhan/WIV05/2019__EPI_ISL_402128 spike protein mRNA gc (1-1211)(A890C_V1040C) Foldon construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucgggugcggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggugcgacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccugugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12397 - RNA, 3998 nt, Artificial Sequence
  SARS-CoV-2/Wuhan/WIV05/2019__EPI_ISL_402128 spike protein mRNA gc (1-1211)(T874C_S1055C) Foldon construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacugcagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagugcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccugugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12398 - RNA, 4370 nt, Artificial Sequence
  SARS-CoV-2/Wuhan/WIV05/2019__EPI_ISL_402128 spike protein mRNA gc (1-1211) WhcAg construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12399 - RNA, 4370 nt, Artificial Sequence
  SARS-CoV-2/Wuhan/WIV05/2019__EPI_ISL_402128 spike protein mRNA gc (1-1211)(K986P_V987P) WhcAg construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12400 - RNA, 4370 nt, Artificial Sequence
  SARS-CoV-2/Wuhan/WIV05/2019__EPI_ISL_402128 spike protein mRNA gc (1-1211)(K986P_V987P_T887WN_A1020W) WhcAg construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggugguucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcuggagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12401 - RNA, 4370 nt, Artificial Sequence
  SARS-CoV-2/Wuhan/WIV05/2019__EPI_ISL_402128 spike protein mRNA gc (1-1211)(K986P_V987P_P1069F) WhcAg construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucuucgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12402 - RNA, 4370 nt, Artificial Sequence
  SARS-CoV-2/Wuhan/WIV05/2019__EPI_ISL_402128 spike protein mRNA gc (1-1211)(K986P_V987P_ H1048Q_H1064N_ H1083N_H1101N) WhcAg construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccagcugauguccuucccccagagcgccccgcacggcguggucuuccucaacgugacguacguccccgcccaggagaagaacuucaccaccgcccccgcgaucugcaacgacgggaaggcccacuucccccgcgagggcguguucguguccaacgggaccaacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12403 - RNA, 4370 nt, Artificial Sequence
  SARS-CoV-2/Wuhan/WIV05/2019__EPI_ISL_402128 spike protein mRNA gc (1-1211)(I712C_T1077C) WhcAg construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcugcgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccugcgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12404 - RNA, 4370 nt, Artificial Sequence
  SARS-CoV-2/Wuhan/WIV05/2019__EPI_ISL_402128 spike protein mRNA gc (1-1211)(I714C_Y1110C) WhcAg construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccugccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucugcgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12405 - RNA, 4370 nt, Artificial Sequence
  SARS-CoV-2/Wuhan/WIV05/2019__EPI_ISL_402128 spike protein mRNA gc (1-1211)(P715C_P1069C) WhcAg construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccaucugcaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucugcgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12406 - RNA, 4370 nt, Artificial Sequence
  SARS-CoV-2/Wuhan/WIV05/2019__EPI_ISL_402128 spike protein mRNA gc (1-1211)(G889C_L1034C) WhcAg construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucugcgccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcgucugcggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12407 - RNA, 4370 nt, Artificial Sequence
  SARS-CoV-2/Wuhan/WIV05/2019__EPI_ISL_402128 spike protein mRNA gc (1-1211)(I909C_Y1047C) WhcAg construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcugcggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaaggggugccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12408 - RNA, 4370 nt, Artificial Sequence
  SARS-CoV-2/Wuhan/WIV05/2019__EPI_ISL_402128 spike protein mRNA gc (1-1211)(Q965C_S1003C) WhcAg construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagugccuguccagcaacuucggcgccaucuccagcgugcugaacgacauccucucccgccuggacaaggucgaggccgaggugcagaucgaccggcugaucaccgggcgccuccagugccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12409 - RNA, 4370 nt, Artificial Sequence
  SARS-CoV-2/Wuhan/WIV05/2019__EPI_ISL_402128 spike protein mRNA gc (1-1211)(F970C_G999C) WhcAg construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacugcggcgccaucuccagcgugcugaacgacauccucucccgccuggacaaggucgaggccgaggugcagaucgaccggcugaucaccugucgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12410 - RNA, 4370 nt, Artificial Sequence
  SARS-CoV-2/Wuhan/WIV05/2019__EPI_ISL_402128 spike protein mRNA gc (1-1211)(A972C_R995C) WhcAg construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcugcaucuccagcgugcugaacgacauccucucccgccuggacaaggucgaggccgaggugcagaucgacugccugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12411 - RNA, 4370 nt, Artificial Sequence
  SARS-CoV-2/Wuhan/WIV05/2019__EPI_ISL_402128 spike protein mRNA gc (1-1211)(A890C_V1040C) WhcAg construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucgggugcggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggugcgacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12412 - RNA, 4370 nt, Artificial Sequence
  SARS-CoV-2/Wuhan/WIV05/2019__EPI_ISL_402128 spike protein mRNA gc (1-1211)(T874C_S1055C) WhcAg construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacugcagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagugcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12413 - RNA, 4196 nt, Artificial Sequence
  SARS-CoV-2/Wuhan/WIV05/2019__EPI_ISL_402128 spike protein mRNA gc (1-1147) LumSynth construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12414 - RNA, 4196 nt, Artificial Sequence
  SARS-CoV-2/Wuhan/WIV05/2019__EPI_ISL_402128 spike protein mRNA gc (1-1147)(K986P_V987P) LumSynth construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12415 - RNA, 4196 nt, Artificial Sequence
  SARS-CoV-2/Wuhan/WIV05/2019__EPI_ISL_402128 spike protein mRNA gc (1-1147)(K986P_V987P_T887WN_A1020W) LumSynth construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggugguucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcuggagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12416 - RNA, 4196 nt, Artificial Sequence
  SARS-CoV-2/Wuhan/WIV05/2019__EPI_ISL_402128 spike protein mRNA gc (1-1147)(K986P_V987P_P1069F) LumSynth construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucuucgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12417 - RNA, 4196 nt, Artificial Sequence
  SARS-CoV-2/Wuhan/WIV05/2019__EPI_ISL_402128 spike protein mRNA gc (1-1147)(K986P_V987P_ H1048Q_H1064N_ H1083N_H1101N) LumSynth construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccagcugauguccuucccccagagcgccccgcacggcguggucuuccucaacgugacguacguccccgcccaggagaagaacuucaccaccgcccccgcgaucugcaacgacgggaaggcccacuucccccgcgagggcguguucguguccaacgggaccaacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12418 - RNA, 4196 nt, Artificial Sequence
  SARS-CoV-2/Wuhan/WIV05/2019__EPI_ISL_402128 spike protein mRNA gc (1-1147)(I712C_T1077C) LumSynth construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcugcgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccugcgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12419 - RNA, 4196 nt, Artificial Sequence
  SARS-CoV-2/Wuhan/WIV05/2019__EPI_ISL_402128 spike protein mRNA gc (1-1147)(I714C_Y1110C) LumSynth construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccugccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucugcgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12420 - RNA, 4196 nt, Artificial Sequence
  SARS-CoV-2/Wuhan/WIV05/2019__EPI_ISL_402128 spike protein mRNA gc (1-1147)(P715C_P1069C) LumSynth construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccaucugcaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucugcgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12421 - RNA, 4196 nt, Artificial Sequence
  SARS-CoV-2/Wuhan/WIV05/2019__EPI_ISL_402128 spike protein mRNA gc (1-1147)(G889C_L1034C) LumSynth construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucugcgccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcgucugcggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12422 - RNA, 4196 nt, Artificial Sequence
  SARS-CoV-2/Wuhan/WIV05/2019__EPI_ISL_402128 spike protein mRNA gc (1-1147)(I909C_Y1047C) LumSynth construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcugcggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaaggggugccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12423 - RNA, 4196 nt, Artificial Sequence
  SARS-CoV-2/Wuhan/WIV05/2019__EPI_ISL_402128 spike protein mRNA gc (1-1147)(Q965C_S1003C) LumSynth construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagugccuguccagcaacuucggcgccaucuccagcgugcugaacgacauccucucccgccuggacaaggucgaggccgaggugcagaucgaccggcugaucaccgggcgccuccagugccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12424 - RNA, 4196 nt, Artificial Sequence
  SARS-CoV-2/Wuhan/WIV05/2019__EPI_ISL_402128 spike protein mRNA gc (1-1147)(F970C_G999C) LumSynth construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacugcggcgccaucuccagcgugcugaacgacauccucucccgccuggacaaggucgaggccgaggugcagaucgaccggcugaucaccugucgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12425 - RNA, 4196 nt, Artificial Sequence
  SARS-CoV-2/Wuhan/WIV05/2019__EPI_ISL_402128 spike protein mRNA gc (1-1147)(A972C_R995C) LumSynth construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcugcaucuccagcgugcugaacgacauccucucccgccuggacaaggucgaggccgaggugcagaucgacugccugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12426 - RNA, 4196 nt, Artificial Sequence
  SARS-CoV-2/Wuhan/WIV05/2019__EPI_ISL_402128 spike protein mRNA gc (1-1147)(A890C_V1040C) LumSynth construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucgggugcggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggugcgacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12427 - RNA, 4196 nt, Artificial Sequence
  SARS-CoV-2/Wuhan/WIV05/2019__EPI_ISL_402128 spike protein mRNA gc (1-1147)(T874C_S1055C) LumSynth construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacugcagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagugcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12428 - RNA, 4220 nt, Artificial Sequence
  SARS-CoV-2/Wuhan/WIV05/2019__EPI_ISL_402128 spike protein mRNA gc (1-1147) Ferritin construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12429 - RNA, 4220 nt, Artificial Sequence
  SARS-CoV-2/Wuhan/WIV05/2019__EPI_ISL_402128 spike protein mRNA gc (1-1147)(K986P_V987P) Ferritin construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12430 - RNA, 4220 nt, Artificial Sequence
  SARS-CoV-2/Wuhan/WIV05/2019__EPI_ISL_402128 spike protein mRNA gc (1-1147)(K986P_V987P_T887WN_A1020W) Ferritin construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggugguucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcuggagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12431 - RNA, 4220 nt, Artificial Sequence
  SARS-CoV-2/Wuhan/WIV05/2019__EPI_ISL_402128 spike protein mRNA gc (1-1147)(K986P_V987P_P1069F) Ferritin construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucuucgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12432 - RNA, 4220 nt, Artificial Sequence
  SARS-CoV-2/Wuhan/WIV05/2019__EPI_ISL_402128 spike protein mRNA gc (1-1147)(K986P_V987P_ H1048Q_H1064N_ H1083N_H1101N) Ferritin construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccagcugauguccuucccccagagcgccccgcacggcguggucuuccucaacgugacguacguccccgcccaggagaagaacuucaccaccgcccccgcgaucugcaacgacgggaaggcccacuucccccgcgagggcguguucguguccaacgggaccaacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12433 - RNA, 4220 nt, Artificial Sequence
  SARS-CoV-2/Wuhan/WIV05/2019__EPI_ISL_402128 spike protein mRNA gc (1-1147)(I712C_T1077C) Ferritin construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcugcgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccugcgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12434 - RNA, 4220 nt, Artificial Sequence
  SARS-CoV-2/Wuhan/WIV05/2019__EPI_ISL_402128 spike protein mRNA gc (1-1147)(I714C_Y1110C) Ferritin construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccugccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucugcgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12435 - RNA, 4220 nt, Artificial Sequence
  SARS-CoV-2/Wuhan/WIV05/2019__EPI_ISL_402128 spike protein mRNA gc (1-1147)(P715C_P1069C) Ferritin construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccaucugcaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucugcgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12436 - RNA, 4220 nt, Artificial Sequence
  SARS-CoV-2/Wuhan/WIV05/2019__EPI_ISL_402128 spike protein mRNA gc (1-1147)(G889C_L1034C) Ferritin construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucugcgccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcgucugcggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12437 - RNA, 4220 nt, Artificial Sequence
  SARS-CoV-2/Wuhan/WIV05/2019__EPI_ISL_402128 spike protein mRNA gc (1-1147)(I909C_Y1047C) Ferritin construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcugcggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaaggggugccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12438 - RNA, 4220 nt, Artificial Sequence
  SARS-CoV-2/Wuhan/WIV05/2019__EPI_ISL_402128 spike protein mRNA gc (1-1147)(Q965C_S1003C) Ferritin construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagugccuguccagcaacuucggcgccaucuccagcgugcugaacgacauccucucccgccuggacaaggucgaggccgaggugcagaucgaccggcugaucaccgggcgccuccagugccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12439 - RNA, 4220 nt, Artificial Sequence
  SARS-CoV-2/Wuhan/WIV05/2019__EPI_ISL_402128 spike protein mRNA gc (1-1147)(F970C_G999C) Ferritin construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacugcggcgccaucuccagcgugcugaacgacauccucucccgccuggacaaggucgaggccgaggugcagaucgaccggcugaucaccugucgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12440 - RNA, 4220 nt, Artificial Sequence
  SARS-CoV-2/Wuhan/WIV05/2019__EPI_ISL_402128 spike protein mRNA gc (1-1147)(A972C_R995C) Ferritin construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcugcaucuccagcgugcugaacgacauccucucccgccuggacaaggucgaggccgaggugcagaucgacugccugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12441 - RNA, 4220 nt, Artificial Sequence
  SARS-CoV-2/Wuhan/WIV05/2019__EPI_ISL_402128 spike protein mRNA gc (1-1147)(A890C_V1040C) Ferritin construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucgggugcggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggugcgacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12442 - RNA, 4220 nt, Artificial Sequence
  SARS-CoV-2/Wuhan/WIV05/2019__EPI_ISL_402128 spike protein mRNA gc (1-1147)(T874C_S1055C) Ferritin construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacugcagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagugcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12443 - RNA, 3806 nt, Artificial Sequence
  SARS-CoV-2/Wuhan/WIV05/2019__EPI_ISL_402128 spike protein mRNA gc (1-1147) Foldon construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccugugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12444 - RNA, 3806 nt, Artificial Sequence
  SARS-CoV-2/Wuhan/WIV05/2019__EPI_ISL_402128 spike protein mRNA gc (1-1147)(K986P_V987P) Foldon construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccugugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12445 - RNA, 3806 nt, Artificial Sequence
  SARS-CoV-2/Wuhan/WIV05/2019__EPI_ISL_402128 spike protein mRNA gc (1-1147)(K986P_V987P_T887WN_A1020W) Foldon construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggugguucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcuggagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccugugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12446 - RNA, 3806 nt, Artificial Sequence
  SARS-CoV-2/Wuhan/WIV05/2019__EPI_ISL_402128 spike protein mRNA gc (1-1147)(K986P_V987P_P1069F) Foldon construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucuucgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccugugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12447 - RNA, 3806 nt, Artificial Sequence
  SARS-CoV-2/Wuhan/WIV05/2019__EPI_ISL_402128 spike protein mRNA gc (1-1147)(K986P_V987P_ H1048Q_H1064N_ H1083N_H1101N) Foldon construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccagcugauguccuucccccagagcgccccgcacggcguggucuuccucaacgugacguacguccccgcccaggagaagaacuucaccaccgcccccgcgaucugcaacgacgggaaggcccacuucccccgcgagggcguguucguguccaacgggaccaacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccugugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12448 - RNA, 3806 nt, Artificial Sequence
  SARS-CoV-2/Wuhan/WIV05/2019__EPI_ISL_402128 spike protein mRNA gc (1-1147)(I712C_T1077C) Foldon construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcugcgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccugcgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccugugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12449 - RNA, 3806 nt, Artificial Sequence
  SARS-CoV-2/Wuhan/WIV05/2019__EPI_ISL_402128 spike protein mRNA gc (1-1147)(I714C_Y1110C) Foldon construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccugccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucugcgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccugugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12450 - RNA, 3806 nt, Artificial Sequence
  SARS-CoV-2/Wuhan/WIV05/2019__EPI_ISL_402128 spike protein mRNA gc (1-1147)(P715C_P1069C) Foldon construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccaucugcaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucugcgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccugugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12451 - RNA, 3806 nt, Artificial Sequence
  SARS-CoV-2/Wuhan/WIV05/2019__EPI_ISL_402128 spike protein mRNA gc (1-1147)(G889C_L1034C) Foldon construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucugcgccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcgucugcggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccugugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12452 - RNA, 3806 nt, Artificial Sequence
  SARS-CoV-2/Wuhan/WIV05/2019__EPI_ISL_402128 spike protein mRNA gc (1-1147)(I909C_Y1047C) Foldon construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcugcggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaaggggugccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccugugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12453 - RNA, 3806 nt, Artificial Sequence
  SARS-CoV-2/Wuhan/WIV05/2019__EPI_ISL_402128 spike protein mRNA gc (1-1147)(Q965C_S1003C) Foldon construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagugccuguccagcaacuucggcgccaucuccagcgugcugaacgacauccucucccgccuggacaaggucgaggccgaggugcagaucgaccggcugaucaccgggcgccuccagugccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccugugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12454 - RNA, 3806 nt, Artificial Sequence
  SARS-CoV-2/Wuhan/WIV05/2019__EPI_ISL_402128 spike protein mRNA gc (1-1147)(F970C_G999C) Foldon construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacugcggcgccaucuccagcgugcugaacgacauccucucccgccuggacaaggucgaggccgaggugcagaucgaccggcugaucaccugucgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccugugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12455 - RNA, 3806 nt, Artificial Sequence
  SARS-CoV-2/Wuhan/WIV05/2019__EPI_ISL_402128 spike protein mRNA gc (1-1147)(A972C_R995C) Foldon construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcugcaucuccagcgugcugaacgacauccucucccgccuggacaaggucgaggccgaggugcagaucgacugccugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccugugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12456 - RNA, 3806 nt, Artificial Sequence
  SARS-CoV-2/Wuhan/WIV05/2019__EPI_ISL_402128 spike protein mRNA gc (1-1147)(A890C_V1040C) Foldon construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucgggugcggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggugcgacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccugugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12457 - RNA, 3806 nt, Artificial Sequence
  SARS-CoV-2/Wuhan/WIV05/2019__EPI_ISL_402128 spike protein mRNA gc (1-1147)(T874C_S1055C) Foldon construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacugcagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagugcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccugugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12458 - RNA, 4178 nt, Artificial Sequence
  SARS-CoV-2/Wuhan/WIV05/2019__EPI_ISL_402128 spike protein mRNA gc (1-1147) WhcAg construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12459 - RNA, 4178 nt, Artificial Sequence
  SARS-CoV-2/Wuhan/WIV05/2019__EPI_ISL_402128 spike protein mRNA gc (1-1147)(K986P_V987P) WhcAg construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12460 - RNA, 4178 nt, Artificial Sequence
  SARS-CoV-2/Wuhan/WIV05/2019__EPI_ISL_402128 spike protein mRNA gc (1-1147)(K986P_V987P_T887WN_A1020W) WhcAg construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggugguucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcuggagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12461 - RNA, 4178 nt, Artificial Sequence
  SARS-CoV-2/Wuhan/WIV05/2019__EPI_ISL_402128 spike protein mRNA gc (1-1147)(K986P_V987P_P1069F) WhcAg construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucuucgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12462 - RNA, 4178 nt, Artificial Sequence
  SARS-CoV-2/Wuhan/WIV05/2019__EPI_ISL_402128 spike protein mRNA gc (1-1147)(K986P_V987P_ H1048Q_H1064N_ H1083N_H1101N) WhcAg construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccagcugauguccuucccccagagcgccccgcacggcguggucuuccucaacgugacguacguccccgcccaggagaagaacuucaccaccgcccccgcgaucugcaacgacgggaaggcccacuucccccgcgagggcguguucguguccaacgggaccaacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12463 - RNA, 4178 nt, Artificial Sequence
  SARS-CoV-2/Wuhan/WIV05/2019__EPI_ISL_402128 spike protein mRNA gc (1-1147)(I712C_T1077C) WhcAg construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcugcgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccugcgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12464 - RNA, 4178 nt, Artificial Sequence
  SARS-CoV-2/Wuhan/WIV05/2019__EPI_ISL_402128 spike protein mRNA gc (1-1147)(I714C_Y1110C) WhcAg construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccugccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucugcgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12465 - RNA, 4178 nt, Artificial Sequence
  SARS-CoV-2/Wuhan/WIV05/2019__EPI_ISL_402128 spike protein mRNA gc (1-1147)(P715C_P1069C) WhcAg construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccaucugcaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucugcgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12466 - RNA, 4178 nt, Artificial Sequence
  SARS-CoV-2/Wuhan/WIV05/2019__EPI_ISL_402128 spike protein mRNA gc (1-1147)(G889C_L1034C) WhcAg construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucugcgccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcgucugcggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12467 - RNA, 4178 nt, Artificial Sequence
  SARS-CoV-2/Wuhan/WIV05/2019__EPI_ISL_402128 spike protein mRNA gc (1-1147)(I909C_Y1047C) WhcAg construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcugcggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaaggggugccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12468 - RNA, 4178 nt, Artificial Sequence
  SARS-CoV-2/Wuhan/WIV05/2019__EPI_ISL_402128 spike protein mRNA gc (1-1147)(Q965C_S1003C) WhcAg construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagugccuguccagcaacuucggcgccaucuccagcgugcugaacgacauccucucccgccuggacaaggucgaggccgaggugcagaucgaccggcugaucaccgggcgccuccagugccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12469 - RNA, 4178 nt, Artificial Sequence
  SARS-CoV-2/Wuhan/WIV05/2019__EPI_ISL_402128 spike protein mRNA gc (1-1147)(F970C_G999C) WhcAg construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacugcggcgccaucuccagcgugcugaacgacauccucucccgccuggacaaggucgaggccgaggugcagaucgaccggcugaucaccugucgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12470 - RNA, 4178 nt, Artificial Sequence
  SARS-CoV-2/Wuhan/WIV05/2019__EPI_ISL_402128 spike protein mRNA gc (1-1147)(A972C_R995C) WhcAg construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcugcaucuccagcgugcugaacgacauccucucccgccuggacaaggucgaggccgaggugcagaucgacugccugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12471 - RNA, 4178 nt, Artificial Sequence
  SARS-CoV-2/Wuhan/WIV05/2019__EPI_ISL_402128 spike protein mRNA gc (1-1147)(A890C_V1040C) WhcAg construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucgggugcggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggugcgacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12472 - RNA, 4178 nt, Artificial Sequence
  SARS-CoV-2/Wuhan/WIV05/2019__EPI_ISL_402128 spike protein mRNA gc (1-1147)(T874C_S1055C) WhcAg construct
aggagagucccgcagucggcguccagcggcucugcuuguucgugugugugucguugcaggccuuauucaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacugcagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagugcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12473 - RNA, 4094 nt, Artificial Sequence
  SARS-CoV-2/Wuhan/WIV05/2019__EPI_ISL_402128 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacaggaaguuuucgcgcaagugaagcagauuuauaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauacggcgacugucuuggggauaucgcagcccgugacuugauuugcgcucagaaguucaacggacugaccguccugcccccacucuuaacagaugaaaugaucgcccaguauacgucagcacugcuugcuggcaccauuacgagugguuggacauuuggggccggcgcggccuugcagaucccuuucgcuaugcaaauggcauaccgguuuaauggaauaggcgugacccagaacgugcucuaugagaaucagaaacugauugccaaccaguucaacuccgcuaucgggaagauucaagacucucuaagcuccacagccucagcacugggaaaacuccaggacgucguuaaucagaacgcgcaggcccugaauacucuugugaagcaauugagcaguaacuuuggcgcuaucucuuccguacugaaugauauauuaagccgacucgacaagguggaagccgagguccagaucgauagacugauuaccgguaggcuucagucgcugcaaacguacgugacacagcaguugauccgcgcagcugagauucgggccucagcaaaccucgccgcuaccaaaaugucugaaugcguucuggggcagaguaagagaguggacuucuguggaaaaggcuaccaccuaauguccuuuccccaaagcgcgccacauggugucguguuccugcacguuacuuaugugccggcccaggagaagaauuuuaccacagcuccugcaaucugccacgauggcaaagcccauuuccccagggaaggggucuuuguaucuaacggaacucacugguucgugacccagcgcaauuuuuacgagccacagauaauuacaacggacaacaccuucguuagcggcaauugugauguggucaucgggaucgugaacaauacuguauaugacccccuccaaccugagcuggauuccuucaaggaggaacuugacaaauacuuuaagaaccauacaucaccagauguggacuugggagauauuaguggcaucaaugccagcgucguuaacauucagaaggaaauagaccgacugaaugagguggcuaaaaacuuaaacgaaucucucaucgaccugcaggagcuugguaaguaugagcaguacauuaaauggcccugguauaucuggcugggguucauugcaggacuaaucgccauagugauggucaccaucaugcucugcuguaugacuuccugcuguucaugccugaagggcuguugcaguugugguagcugcugcaaauuugaugaagacgauuccgagccuguguugaagggcguuaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12474 - RNA, 4082 nt, Artificial Sequence
  SARS-CoV-2/bat/Yunnan/RaTG13/2013__EPI_ISL_402131 spike protein mRNA human (1-1269)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacaccaauucuucaacgaggggcguauauuacccggacaagguguuccggaguagcguccugcaccuaacacaggaucucuuucugcccuucuuuuccaacgugacuugguuccaugcuauccacguuucugggaccaauggaauuaaacgcuuugacaacccugugcuuccauucaaugauggugucuauuuugcaucgacagagaagucaaacauaauccgaggcuggauuuucgggaccacucuggacagcaaaacacagaguuugcucaucgugaauaacgccaccaauguaguuauuaaggugugugaauuucaguucugcaacgaucccuuucugggagucuacuaucauaaaaauaacaaguccuggauggagucugaguuccguguguacagcuccgcgaauaacuguacguucgaauaugugucacaaccuuuucugauggaccucgaaggcaagcaggguaauuucaaaaacuuaagagaguuugucuucaagaacaucgauggguacuuuaaaauauacaguaagcacacuccaaucaaucugguuagggaccuucccccuggauucagcgcuuuggagccacugguggaucuaccgauuggcaucaacauuacccgguuucagacacuccuggcccuucaucgcucuuaucugacucccggcgacuccucaagcggguggaccgcaggagccgcugcauacuauguagguuacuugcagccuagaacauuccuccugaaauauaaugaaaacggcaccaucacggaugccguggacugcgcuuuagauccacugagugagacuaaguguacacucaagucuuuuaccgucgaaaaagggauauaccaaacuuccaauuucagggugcagcccacagacagcauuguucgguuuccuaacaucaccaaucuuugcccauucggagagguguuuaacgccacgaccuucgcgucggucuaugcauggaaucgcaagcgaauuucuaacuguguggccgacuacuccguacuguacaauucaacaaguuucagcacuuuuaaaugcuauggcguuucccccaccaaguugaacgaucuauguuucacaaauguguacgcugacucuuuugucaucacuggugaugaggugagacagaucgccccggggcagaccggaaaaauugcagacuauaacuacaagcugccugaugacuucacaggcugcgucauagcuuggaauagcaaacacaucgaugccaaggaaggcgggaacuuuaacuaucucuacaggcuguuccggaaggcgaaucuuaaacccuuugagcgugacauuucaaccgaaaucuaucaagccggaaguaagccauguaacggucagacuggccugaauugcuacuacccuuuguaucgcuacggguucuaucccacggauggagugggccaccagccauacagaguugugguacucuccuuugagcuguuaaacgcacccgcuacagucugcgguccuaaaaagagcaccaaucuggugaaaaacaaguguguuaauuucaacuuuaaugggcuaacuggcaccggagugcucacagaaucuaacaagaaauuccugccauuucaacaguucggcagggacauagccgauaccacugacgcuguccgggacccgcagacacuugagauuuuggauaucacgcccugcucauucgggggagugaguguaaucaccccugguacuaaugccagcaaccagguggcaguucuguaucaagacgucaauuguacagaggugccaguggccauucaugcugaucagcucacccccacauggcgagucuacuccacuggcucuaacguuuuucagacccgcgcggggugccugaucggagcagaacacgugaauaacucguaugagugugacauuccuauaggcgccgguaucugcgcuagcuaccagacgcaaaccaacuccagaucaguggccagucagucuauuaucgcauacacaaugagccuuggggccgaaaauuccguagcuuauucaaacaauagcaucgccauuccaacuaacuucaccauaucugucacaacugagauccugcccguguccaugaccaagacgaguguugauuguacaauguacauuugcggcgacagcaccgaauguucuaauuugcuccugcaguauggauccuuuugcacucaguuaaacagggcacugacaggcaucgcgguggagcaagauaaaaauacccaggaggucuucgcucaggugaagcagauuuacaaaacuccgccuaucaaggacuuugggggauucaacuuuucacaaauacuaccagaucccaguaagccuagcaaacggucguucaucgaagaccuccuguuuaauaagguuacccuugccgaugcagguuucauuaaacaguauggcgacuguuugggggauaucgccgcucgcgaccugauuugcgcccagaaguuuaacggacucacagugcugcccccauuacugacggacgagaugaucgcacaauacaccuccgcucuuuuggccggcacuauaacaucugguuggaccuucggggcgggcgccgcucuccagauuccuuucgcaaugcagauggccuauagauuuaauggaaucggcguaacacagaacguccuguacgaaaaucaaaaacuaauugcuaaccaguucaauagcgccaucgggaagauacaggauucacugaguuccacugcaucugcgcucggaaagcugcaggacguggugaaccaaaacgcccaggcucuuaauaccuuggucaaacagcugagcuccaacuuuggcgccaucucaagcguuuuaaaugauauucucaguaggcuggacaagguggaggcagaaguacagaucgaucgucuuauuacgggucggcugcaaucuuugcagacauacgugacccagcaacucauccgagcugccgagauaagagcauccgccaaccuggcugcgacuaaaaugagcgagugcguccuagggcagucgaagaggguggacuucuguggaaaaggcuaucaucugaugucauuuccccagucugccccacacgguguuguguuccuccacgucaccuacgugccggcacaggaaaagaauuuuacaacugcuccugccauuugccaugauggcaaagcccacuucccccgcgaggggguuuuugugaguaacggaacccauugguucgucacacaacggaauuuuuaugaaccacagaucaucacgaccgacaacacuuucguauccggcagcugugaugugguuauugggaucgugaauaacacagucuacgacccccugcagccugagcuugauucuuuuaaggaggaauuggacaaguauuucaaaaaucacaccagcccagauguggaccugggagacauuuccggcauaaacgcuucaguagugaauauccagaaggagauugauagauuaaacgaagucgccaaaaaucucaacgagagucugaucgaccuucaagaacuggguaaguacgagcaguauauuaaauggcccugguacaucuggcuaggguucauagcaggacucaucgcgauuaucaugguuacuauuaugcugugcuguaugacaagcugcuguucuugcuugaagggcuguugcuccugugguucaugcugcaaguuugaugaggacgauagugaaccugugcugaaaggcgugaaguuacauuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12475 - RNA, 4094 nt, Artificial Sequence
  SARS-CoV-2/Wuhan/HBCDC-HB-01/2019__EPI_ISL_402132 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuaucaccaggggcguauauuacccggacaagguguuccggucaaguguccugcacagcacacaggaucuauuucuccccuucuuuuccaacgugacuugguuccaugcuauucacguuucugggaccaauggaacaaaacgcuuugacaacccugugcugccauucaaugauggugucuauuuugcaucgaccgagaagucaaacauaauccgaggcuggauuuucgggacuacacuugacagcaaaacccagagucuguugaucgugaauaacgccacgaauguaguuauuaaggugugugaauuucaguucugcaacgaucccuuucucggagucuacuaucauaaaaauaacaaguccuggauggagucugaguuccguguguacagcuccgcgaauaacuguacuuucgaguaugugucacaaccuuuucugauggaccuggaaggcaagcaggguaauuucaaaaaccucagagaguuugucuucaagaacaucgauggguacuuuaaaauauacaguaagcacaccccaaucaauuuaguuagggaccugccccagggauucagcgcucuugagccuuugguggaucugccaauuggcaucaacauuacacgguuucagacucuacucgcccugcaucgcucuuaucuuaccccgggcgacuccucaagcggguggacagcaggagccgcugcauacuauguagguuaccugcaacccagaaccuucuugcucaaauauaaugaaaacggcacgaucacugaugccguggacugcgcucuggauccuuuaagugagacaaaguguacccugaagucuuuuacugucgaaaaagggauauaccagacauccaauuucagggugcagccaaccgagagcauuguucgguuucccaacaucacgaaucucugcccuuucggagagguguuuaacgccacccgcuucgcgucggucuaugcauggaaucgaaagagaauuucuaacuguguggccgacuacuccguacuuuacaauucagcuaguuucagcacauuuaaaugcuauggcguuuccccaacuaagcugaacgacuuguguuucaccaauguguacgccgauucuuuugucaucaggggugacgaagugcggcagaucgcacccgggcaaacaggaaaaauugcugauuauaacuacaagcuaccggacgauuucacuggcugcgucauagccuggaauagcaacaaccuggacucaaaagugggcgggaauuauaacuaccucuaucgucuguuucgcaagaguaaucuuaagccuuucgagagagauaucuccaccgaaauuuaccaggcgggaagcacacccuguaacgguguugagggcuuuaauugcuacuucccacugcagucuuauggguuucaaccuaccaacggagugggcuaccagcccuauaggguagucguguugucauucgaacuccugcacgccccagcaacuguuugcggucccaaaaagaguacgaauuuagugaaaaacaagugugucaauuuuaacuucaaugggcugacaggcaccggagugcuaacugagagcaacaaaaaguuucucccuuuccagcaguucggccgggacaucgcugauaccacagacgccguacgagauccacaaacccuggagauacuugacauuacuccgugcuccuuugggggagugucuguuaucacacccgguacgaauaccucgaaccaggucgcuguguuguaccaggacgugaauuguacugaagucccuguugccauccacgcagaucagcugacaccaaccuggcgcguguauagcacaggcuccaacguguuccaaacuagagccgggugccucauuggagcugagcauguaaacaauucauacgaaugugacauccccauuggcgcggguauaugcgcaaguuaucagacccagacgaacucuccuaggcgggcccgcagcgucgcuucccagucaaucauugccuacaccaugagccugggggcagaaaauucuguggccuacuccaacaauaguaucgcuaucccaacaaacuuuacuauuagcguuaccacagaaauacuucccgugucuaugacuaagaccuccgucgauuguacgauguauaucugcggcgacucaacagaguguaguaaucuguugcuccaauacggcagcuucugcacccagcugaacagagccuuaacuggaauugcaguggagcaggauaaaaauacacaggaaguuuuugcgcaagugaagcagaucuauaaaaccccgccuauuaaggacuucgggggauuuaacuucucgcagauccugccagaucccuccaaaccuucuaagaggagcuuuauagaggaccuacucuucaauaagguaacucuggcugaugccgguuuuaucaaacaauacggcgacugucuuggggauauugcagcccgugacuugaucugcgcucagaaguucaacggacugaccguccugcccccacucuuaacagaugaaaugauugcccaguauacgucagcacugcuugcuggcaccaucacgagugguuggacauucggggccggcgcggccuugcagauaccuuuugcuaugcaaauggcauaccgguucaauggaauuggcgugacccagaacgugcucuaugagaaucagaaacugaucgccaaccaguuuaacuccgcuauugggaagauccaagacucucuaagcuccacagccucagcacugggaaaacuccaggacgucguuaaucagaacgcgcaggcccugaauacucuugugaagcaauugagcaguaacuucggcgcuauaucuuccguacugaaugauaucuuaagccgacucgacaagguggaagccgagguccagauugauagacugaucaccgguaggcuucagucgcugcaaacguacgugacacagcaguugauucgcgcagcugagauccgggccucagcaaaccucgccgcuaccaaaaugucugaaugcguucuggggcagaguaagagaguggacuuuuguggaaaaggcuaccaccuaauguccuucccccaaagcgcgccacauggugucguguuucugcacguuacuuaugugccggcccaggagaagaauuucaccacagcuccugcaauaugccacgauggcaaagcccauuuucccagggaaggggucuucguaucuaacggaacucacugguuugugacccagcgcaauuucuacgagccacagauuaucacaacggacaacaccuuuguuagcggcaauugugauguggucaucgggauugugaacaauacuguauaugacccccuccaaccugagcuggauuccuucaaggaggaacuugacaaauacuucaagaaccauacaucaccagauguggacuugggagauaucaguggcauuaaugccagcgucguuaacauacagaaggaaaucgaccgacugaaugagguggcuaaaaacuuaaacgaaucucucauugaccugcaggagcuugguaaguaugagcaguacaucaaauggcccugguauauuuggcugggguuuaucgcaggacuaauagccaucgugauggucaccauuaugcucugcuguaugacuuccugcuguucaugccugaagggcuguugcaguugugguagcugcugcaaauucgaugaagacgauuccgagccuguguugaagggcguuaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12476 - RNA, 4094 nt, Artificial Sequence
  SARS-CoV-2/Guangdong/20SF028/2020__EPI_ISL_403936 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccuguauagcacacaggaucuauuccuccccuuuuucuccaacgugacuugguuucacgcuauccauguuucugggaccaauggaacaaaacgcuucgacaacccugugcugccauuuaaugauggugucuacuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuauuaccacaaaaauaacaaguccuggauggagucugaguuccguguguauagcuccgcgaauaacuguacuuuugaauacgugucacaaccuuuccugauggaccuggaaggcaagcaggguaauuuuaaaaaccucagagaguucgucuuuaagaacauugauggguacuucaaaaucuauaguaagcauaccccaauaaauuuaguuagggaccugccccagggauuuagcgcucuugagccuuugguggaucugccaaucggcauuaacaucacacgguuccagacucuacucgcccugcaccgcucuuaccuuaccccgggcgacuccucaagcggguggacagcaggagccgcugcauauuacguagguuaucugcaacccagaaccuuuuugcucaaauacaaugaaaacggcacgauuacugaugccguggacugcgcucuggauccuuuaagugagacaaaguguacccugaagucuuucacugucgaaaaagggaucuaucagacauccaauuuuagggugcagccaaccgagagcauaguucgguuccccaacauuacgaaucucugcccuuuuggagagguguucaacgccacccgcuucgcgucggucuacgcauggaaucgaaagagaaucucuaacuguguggccgacuacuccguacuuuauaauucagcuaguuuuagcacauucaaaugcuacggcguuuccccaacuaagcugaacgacuuguguuuuaccaauguguaugccgauucuuucgucauuaggggugacgaagugcggcagaucgcacccgggcaaacaggaaaaaucgcugauuacaacuauaagcuaccggacgauuuuacuggcugcgucauugccuggaauagcaacaaccuggacucaaaagugggcgggaauuacaacuaucucuaccgucuguuccgcaagaguaaucuuaagccuuuugagagagauauauccaccgaaaucuaccaggcgggaagcacacccuguaacgguguugagggcuucaauugcuauuuuccacugcagucuuacggguuccaaccuaccaacggagugggcuaucagcccuacaggguagucguguugucauuugaacuccugcaugccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaucaggacgugaauuguacugaagucccuguugccauccacgcagaucagcugacaccaaccuggcgcguguacagcacaggcuccaacguguuucaaacuagagccgggugccucaucggagcugagcacguaaacaauucauaugaaugugacauucccaucggcgcggguauuugcgcaaguuaccagacccagacgaacucuccuaggcgggcccgcagcgucgcuucccagucaauaaucgccuacaccaugagccugggggcagaaaauucuguggccuauuccaacaauaguauugcuaucccaacaaacuucacuaucagcguuaccacagaaauucuucccgugucuaugacuaagaccuccgucgauuguacgauguacauaugcggcgacucaacagaguguaguaaucuguugcuccaauauggcagcuuuugcacccagcugaacagagccuuaacuggaaucgcaguggagcaggauaaaaauacacaggaaguuuucgcgcaagugaagcagauuuacaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauauggcgacugucuuggggauaucgcagcccgugacuugauuugcgcucagaaguucaacggacugaccguccugcccccacucuuaacagaugaaaugaucgcccaguacacgucagcacugcuugcuggcaccauuacgagugguuggacauuuggggccggcgcggccuugcagaucccuuucgcuaugcaaauggcauaucgguuuaauggaauaggcgugacccagaacgugcucuacgagaaucagaaacugauugccaaccaguucaacuccgcuaucgggaagauucaagacucucuaagcuccacagccucagcacugggaaaacuccaggacgucguuaaucagaacgcgcaggcccugaauacucuugugaagcaauugagcaguaacuuuggcgcuaucucuuccguacugaaugauauauuaagccgacucgacaagguggaagccgagguccagaucgauagacugauuaccgguaggcuucagucgcugcaaacguacgugacacagcaguugauccgcgcagcugagauucgggccucagcaaaccucgccgcuaccaaaaugucugaaugcguucuggggcagaguaagagaguggacuucuguggaaaaggcuaucaucuaauguccuuuccccaaagcgcgccacacggugucguguuccugcauguuacuuacgugccggcccaggagaagaauuuuaccacagcuccugcaaucugccacgauggcaaagcccacuuccccagggaaggggucuuuguaucuaacggaacucauugguucgugacccagcgcaauuuuuaugagccacagauaauuacaacggacaacaccuucguuagcggcaauugugauguggucaucgggaucgugaacaauacuguauacgacccccuccaaccugagcuggauuccuucaaggaggaacuugacaaauauuuuaagaaccacacaucaccagauguggacuugggagauauuaguggcaucaaugccagcgucguuaacauucagaaggaaauagaccgacugaaugagguggcuaaaaacuuaaacgaaucucucaucgaccugcaggagcuugguaaguacgagcaguauauuaaauggcccugguacaucuggcugggguucauugcaggacuaaucgccauagugauggucaccaucaugcucugcuguaugacuuccugcuguucaugccugaagggcuguugcaguugugguagcugcugcaaauuugaugaagacgauuccgagccuguguugaagggcguuaagcugcauuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12477 - RNA, 4094 nt, Artificial Sequence
  SARS-CoV-2/Shenzhen/SZTH-001/2020__EPI_ISL_406592 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacaggaaguuuucgcgcaagugaagcagauuuauaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauacggcgacugucuuggggauaucgcagcccgugacuugauuugcgcucagaaguucaacggacugaccguccugcccccacucuuaacagaugaaaugaucgcccaguauacgucagcacugcuugcuggcaccauuacgagugguuggacauuuggggccggcgcggccuugcagaucccuuucgcuaugcaaauggcauaccgguuuaauggaauaggcgugacccagaacgugcucuaugagaaucagaaacugauugccaaccaguucaacuccgcuaucgggaagauucaagacucucuaagcuccacagccucagcacugggaaaacuccaggacgucguuaaucagaacgcgcaggcccugaauacucuugugaagcaauugagcaguaacuuuggcgcuaucucuuccguacugaaugauauauuaagccgacucgacaagguggaagccgagguccagaucgauagacugauuaccgguaggcuucagucgcugcaaacguacgugacacagcaguugauccgcgcagcugagauucgggccucagcaaaccucgccgcuaccaaaaugucugaaugcguucuggggcagaguaagagaguggacuucuguggaaaaggcuaccaccuaauguccuuuccccaaagcgcgccacauggugucguguuccugcacguuacuuaugugccggcccaggagaagaauuuuaccacagcuccugcaaucugccacgauggcaaagcccauuuccccagggaaggggucuuuguaucuaacggaacucacugguucgugacccagcgcaauuuuuacgagccacagauaauuacaacggacaacaccuucguuagcggcaauugugaugugcucaucgggaucgucaacaauacuguguaugacccccugcaaccugagcuugauuccuucaaggaagaguuggacaaauacuuuaagaaccauacaucaccagauguagaccugggagauauuaguggcaucaaugccagcguggucaacauucagaaggaaauagaccgauuaaaugagguugcuaaaaaccucaacgaaucucugaucgaccuucaggagcuggguaaguaugagcaguacauuaaauggcccugguauaucuggcuaggguucauugcaggacucaucgccauagugauggugaccaucaugcugugcuguaugacuuccugcuguucaugcuugaagggcuguugcaguugugguagcugcugcaaauuugaugaagacgauuccggcccuguccugaagggggugaaguuacacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12478 - RNA, 4094 nt, Artificial Sequence
  SARS-CoV-2/Shenzhen/SZTH-004/2020__EPI_ISL_406595 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacgaauagcuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcaugggaccgaaagagaaucucuaauuguguggccuacuacuccguacuuuauaacucagcuaguuuuagcacauucaaaugcuacggcguuuccccaacuaagcugaaugacuuguguuuuaccaacguguaugccgauucuuucgucauuaggggugacgaagugcggcagaucgcacccgggcaaacaggaaaaaucgcugauuacaauuauaagcuaccggacgauuuuacuggcugcgucauugccuggaacagcaauaaccuggacucaaaagugggcgggaacuacaauuaucucuaccgucuguuccgcaagaguaaccuuaagccuuuugagagagauauauccaccgaaaucuaccaggcgggaagcacacccuguaaugguguugagggcuucaacugcuauuuuccacugcagucuuacggguuccaaccuaccaauggagugggcuaucagcccuacaggguagucguguugucauuugaacuccugcacgccccagcaacuguuugcggucccaaaaagaguacgaacuuagugaaaaauaagugugucaacuucaauuuuaacgggcugacaggcaccggagugcuaacugagagcaauaaaaaguuccucccuuuccagcaguuuggccgggacauugcugauaccacagacgccguacgagauccacaaacccuggagauccuugacauaacuccgugcuccuucgggggagugucuguuauuacacccgguacgaacaccucgaaucaggucgcuguguuguaucaggacgugaacuguacugaagucccuguugccauccacgcagaucagcugacaccaaccuggcgcguguacagcacaggcuccaauguguuucaaacuagagccgggugccucaucggagcugagcauguaaacaacucauaugaaugugacauucccaucggcgcggguauuugcgcaaguuaccagacccagacuaauucuccuaggcgggcccgcagcgucgcuucccagucaauaaucgccuacaccaugagccugggggcagagaacucuguggccuauuccaauaacaguauugcuaucccaacaaauuucacuaucagcguuaccacagaaauucuucccgugucuaugacuaagaccuccgucgauuguacgauguacauaugcggcgacucaacagaguguaguaaccuguugcuccaauauggaucuuuuugcacccagcugaauagagccuuaacuggcaucgcaguggagcaggauaaaaacacacaggaaguuuucgcgcaagugaagcagauuuacaaaaccccgccuaucaaggacuuugggggauucaauuuuucgcagauucugccagaucccuccaaaccuucuaagaggagcuucaucgaggaccuacucuuuaacaagguaacucuggcugaugccgguuucauaaaacaauauggcgacugucuuggggauaucgcagcccgugacuugauuugcgcucagaaguucaauggacugaccguccugcccccacucuuaacagaugaaaugaucgcccaguacacgucagcacugcuugcuggcaccauuacgagugguuggacauuuggggccggcgcggccuugcagaucccuuucgcuaugcaaauggcauaucgguuuaacggaauaggcgugacccagaaugugcucuacgagaaccagaaacugauugccaaucaguucaacuccgcuaucgggaagauucaagacucucuaagcuccacagccucagcacugggaaaacuccaggacgucguuaaccagaaugcgcaggcccugaacacucuugugaagcaauugagcaguaauuuuggcgcuaucucuuccguacugaacgauauauuaagccgacucgacaagguggaagccgagguccagaucgauagacugauuaccgguaggcuucagucgcugcaaacguacgugacacagcaguugauccgcgcagcugagauucgggccucagcaaaucucgccgcuaccaaaaugucugaaugcguucuggggcagaguaagagaguggacuucuguggaaaaggcuaucaccuaauguccuuuccccaaagcgcgccacauggugucguguuccugcacguuacuuacgugccggcccaggagaagaacuuuaccacagcuccugcaaucugccacgauggcaaagcccauuuccccagggaaggggucuuuguaucuaauggaacucacugguucgugacccagcgcaacuuuuaugagccacagauaauuacaacggacaauaccuucguuagcggcaacugugauguggucaucgggaucgugaauaacacuguauacgacccccuccaaccugagcuggauuccuucaaggaagaacuugacaaauauuuuaagaaucauacaucaccagauguggacuugggagauauuaguggcaucaacgccagcgucguuaauauucagaaggaaauagaccgacugaacgagguggcuaaaaauuuaaacgaaucucucaucgaccugcaggagcuugguaaguacgagcaguauauuaaauggcccugguacaucuggcugggguucauugcaggacuaaucgccauagugauggucaccaucaugcucugcuguaugacuuccugcuguucaugccugaagggcuguugcaguugugguagcugcugcaaauuugaugaagacgauuccgagccuguguugaagggcguuaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12479 - RNA, 4094 nt, Artificial Sequence
  SARS-CoV-2/France/IDF0372/2020__EPI_ISL_406596 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccuuucuuuacaauucagcuaguuucagcacauuuaaaugcuauggcguauccccaacuaagcugaacgacuuguguuucaccaauguuuacgccgauucuuuugugauuaggggugacgaaguccggcagaucgcacccgggcaaacaggaaaaaucgcugauuauaacuacaagcuaccggacgauuucacuggcugcgugauugccuggaauagcaacaaccuggacucaaaagucggcgggaauuauaacuaccucuaucgucuguuucgcaagaguaaucuuaagccuuucgagagagauauauccaccgaaaucuaccaggcgggaagcacacccuguaacgguguggagggcuuuaauugcuacuucccacugcagucuuauggguuucaaccuaccaacggaguuggcuaccagcccuauagggugguagucuugucauucgaacuccugcacgccccagcaacugugugcggucccaaaaagaguacgaauuuaguuaaaaacaagugugugaauuuuaacuucaaugggcugacaggcaccggaguccuaacugagagcaacaaaaaguuccucccuuuucagcaguucggccgggacauugcugauaccacagacgccgugcgagauccacaaacccuggagauccuugacauaacuccgugcuccuuugggggaguaucugugauuacacccgguacgaauaccucgaaccagguugcugucuuguaccaggacgugaauuguacugaagugccugucgccauccacgcagaucagcugacaccaaccuggcgcguuuauagcacaggcuccaacguguuccaaacuagagccgggugccucaucggagcugagcaugugaacaauucauacgaaugugacauucccaucggcgcggguauuugcgcaaguuaucagacccagacgaacucuccuaggcgggcccgcagcguagcuucccagucaauaaucgccuacaccaugagccugggggcagaaaauucugucgccuacuccaacaauaguauugcuaucccaacaaacuuuacuaucagcgugaccacagaaauucuucccguuucuaugacuaagaccuccguggauuguacgauguauauaugcggcgacucaacagaguguaguaaucuguugcuccaauacggcagcuucugcacccagcugaacagagccuuaacuggaaucgcagucgagcaggauaaaaauacacaggaaguguuugcgcaaguuaagcagauuuauaaaaccccgccuaucaaggacuucgggggauuuaacuucucgcagauucugccagaucccuccaaaccuucuaagaggagcuuuaucgaggaccuacucuucaauaaggugacucuggcugaugccgguuucauaaaacaauacggcgacugucuuggggauaucgcagcccgugacuugauuugcgcucagaaguuuaacggacugaccguacugcccccacucuuaacagaugaaaugaucgcccaguauacgucagcacugcuugcuggcaccauuacgagugguuggacauucggggccggcgcggccuugcagaucccuuuugcuaugcaaauggcauaccgguucaauggaauaggcgucacccagaacgugcucuaugagaaucagaaacugauugccaaccaguuuaacuccgcuaucgggaagauucaagacucucuaagcuccacagccucagcacugggaaaacuccaggacguggucaaucagaacgcgcaggcccugaauacucuuguuaagcaauugagcaguaacuucggcgcuaucucuuccgugcugaaugauauauuaagccgacucgacaagguagaagccgaggugcagaucgauagacugauuaccgguaggcuucagucgcugcaaacguacgucacacagcaguugauccgcgcagcugagauucgggccucagcaaaccucgccgcuaccaaaaugucugaaugcgugcuggggcagaguaagagaguugacuuuuguggaaaaggcuaccaccuaauguccuucccccaaagcgcgccacaugguguggucuuucugcacgugacuuauguuccggcccaggagaagaauuucaccacagcuccugcaaucugccacgauggcaaagcccauuuucccagggaagggguguucgucucuaacggaacucacugguuuguaacccagcgcaauuucuacgagccacagauaauuacaacggacaacaccuucgugagcggcaauugugauguugugaucgggaucgucaacaauacuguguaugacccccuccaaccugagcuggauuccuuuaaggaggaacuugacaaauacuucaagaaccauacaucaccagauguagacuugggagauauuaguggcaucaaugccagcguggucaacauucagaaggaaauagaccgacugaaugagguugcuaaaaacuuaaacgaaucucucaucgaccugcaggagcuugguaaguaugagcaguacauuaaauggcccugguauaucuggcugggguuuauugcaggacuaaucgccauagugauggugaccaucaugcucugcuguaugacuuccugcuguucaugccugaagggcuguugcaguugugguagcugcugcaaauucgaugaagacgauuccgagccugucuugaagggcgugaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12480 - RNA, 4094 nt, Artificial Sequence
  SARS-CoV-2/Australia/VIC01/2020__EPI_ISL_406844 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacaccaauucuuucacgaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcagauaucuuaccccgggcgacucuuccucaggguggacagcaggagccgcugcauacuauguagguuaccugcaacccaggaccuuuuugcucaaauauaaugaaaacggcacgauuacugaugccguggacugcgcucuggauccuuuaagcgagacaaaguguacccugaagaguuucacugucgaaaaagggaucuaccagacaucuaauuuucgggugcagccaaccgaguccauaguucgcuuccccaacauuacgaaucucugcccuuuuggagagguguucaacgccacccgauucgcgagcgucuaugcauggaauagaaagaggaucucgaacuguguggccgacuacucuguacuuuacaauuccgcuucauuuaguacauucaaaugcuauggcguuagcccaacuaagcugaacgacuuguguuuuaccaauguguacgccgauuccuucgucauucggggugacgaagugcgucagaucgcacccgggcaaacaggaaaaaucgcugauuauaacuacaagcuaccggacgauuuuacuggcugcgucauugccuggaacucuaauaaccuggacagcaaagugggcgggaauuauaacuaccucuaucgccuguucagaaagucaaaucuuaagccuuuugagagggauauaaguaccgaaaucuaccaggcgggauccacacccuguaacgguguugagggcuucaauugcuacuuuccacugcagagcuauggguuccaaccuaccaacggagugggcuaccagcccuaucggguagucguguugucuuuugaacuccugcacgccccagcaacuguuugcggucccaaaaagucaacgaauuuagugaaaaacaagugugucaauuucaacuuuaaugggcugacaggcaccggagugcuaacugagaguaacaaaaaguuccucccuuuccagcaguuuggccgagacauugcugauaccacagacgccguacgcgauccacaaacccuggagauccuugacauaacuccgugcagcuucgggggaguguccguuauuacacccgguacgaauaccucuaaccaggucgcuguguuguaccaggacgugaauuguacugaagucccuguugccauccacgcagaucagcugacaccaaccuggagaguguauucgacaggcagcaacguguuucaaacuagggccgggugccucaucggagcugagcauguaaacaauuccuacgaaugugacauucccaucggcgcggguauuugcgcaucauaucagacccagacgaacaguccucggcgcgccagaucugucgcuagccaguccauaaucgccuacaccaugucacugggggcagagaauagcguggccuacucuaacaauuccauugcuaucccaacaaacuucacuaucaguguuaccacagaaauucuucccgugagcaugacuaagaccucugucgauuguacgauguauauaugcggcgacuccacagaguguucaaaucuguugcuccaauacggaaguuuuugcacccagcugaacagggccuuaacuggcaucgcaguggagcaggauaaaaauacacaggaaguuuucgcgcaagugaagcagauuuauaaaaccccgccuaucaaggacuuugggggauucaacuuuagccagauucugccagaucccucgaaaccuuccaagcguucuuucaucgaggaccuacucuuuaauaagguaacucuggcugaugccgguuucauaaaacaauacggcgacugucuuggggauaucgcagcccgggacuugauuugcgcucagaaguucaacggacugaccguccucccuccacuguuaacagaugaaaugaucgcccaguauacgagcgcacugcuugcuggcaccauuacuucagguuggacauuuggggccggcgcggccuugcagaucccuuucgcuaugcaaauggcauaccgauuuaauggaauaggcgugacccagaacgugcucuaugagaaucagaaacugauugccaaccaguucaacagugcuaucgggaagauucaagacucccuaucuagcacagccuccgcacugggaaaacuccaggacgucguuaaucagaacgcgcaggcccugaauacucuugugaagcaauugucaagcaacuuuggcgcuaucaguucuguacugaaugauauauuauccagacucgacaagguggaagccgagguccagaucgauaggcugauuaccggucgccuucagagccugcaaacguacgugacacagcaguugauccgggcagcugagauuagagccucggcaaaccucgccgcuaccaaaaugucagaaugcguucuggggcagucuaagaggguggacuucuguggaaaaggcuaccaccuaaugaguuuuccccaauccgcgccacauggugucguguuccugcacguuacuuaugugccggcccaggagaagaauuuuaccacagcacccgcuaucugccacgauggcaaagcccauuucccccgcgaaggggucuuuguaagcaacggaacucacugguucgugacccagcgaaauuuuuacgagccacagauaauuacaacggacaacaccuucguuucuggcaauugugauguggucaucgggaucgugaacaauacuguauaugacccccuccaaccugagcuggauagcuucaaggaagaacuugacaaauacuuuaagaaccauacauccccagauguggacuugggagauauuucaggcaucaaugccagugucguuaacauucagaaggaaauagaccggcugaaugagguggcuaaaaacuuaaacgaaagccucaucgaccugcaggagcuugguaaguaugagcaguacauuaaauggcccugguauaucuggcugggguucauugcaggacuaaucgccauagugauggucaccaucaugcucugcuguaugacuucuugcuguuccugccugaagggcuguugcucaugugguaguugcugcaaauuugaugaagacgauagcgagccuguguugaagggcguuaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12481 - RNA, 4094 nt, Artificial Sequence
  SARS-CoV-2/Germany/BavPat1/2020__EPI_ISL_406862 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgcagcccgugauuugauuugcgcucagaaguucaacggccugaccguccugcccccacucuuaacagacgaaaugaucgcccaguauacgucagcacugcuugcugguaccauuacgaguggguggacauuuggcgccggagcggccuugcagaucccuuucgcuaugcaaauggcauaccgguuuaauggcauaggggugacccagaacgugcucuaugagaaucagaaacugauugccaaccaguucaacuccgcuaucggaaagauucaagauucucuaagcuccacagccucagcacugggcaaacuccaggacgucguuaaucagaacgcgcaggcccugaauacucuugugaagcaauugagcaguaacuuuggugcuaucucuuccguacugaaugacauauuaagccgacucgauaagguggaagccgagguccagaucgacagacugauuaccgggaggcuucagucgcugcaaacguacgugacacagcaguugauccgcgcagcugagauucgggccucagcaaaccucgccgcuaccaaaaugucugaaugcguucugggacagaguaagagaguggauuucuguggcaaagguuaccaccuaauguccuuuccccaaagcgcgccacauggcgucguguuccugcacguuacuuaugugccggcccaggagaagaauuuuaccacagcuccugcaaucugccacgacgggaaagcccauuuccccagggaaggagucuuuguaucuaacggcacucacugguucgugacccagcgcaauuuuuacgagccacagauaauuacaacggauaacaccuucguuagcgggaauugugacguggucaucggaaucgugaacaauacuguauaugauccccuccaaccugagcuggacuccuucaaggaagaacuugauaaauacuuuaagaaccauacaucaccagacguggauuugggcgacauuagugguaucaaugccagcgucguuaacauucagaaggaaauagaucgacugaaugagguggcuaaaaacuuaaacgaaucucucaucgaccugcaggagcuugggaaguaugagcaguacauuaaauggcccugguauaucuggcugggauucauugcaggccuaaucgccauagugauggucaccaucaugcucugcuguaugacuuccugcuguucaugccugaaggguuguugcaguuguggcagcugcugcaaauuugacgaagaugacuccgagccuguguugaaggggguuaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12482 - RNA, 4094 nt, Artificial Sequence
  SARS-CoV-2/Wuhan/HBCDC-HB-02/2020__EPI_ISL_412978 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaauuuucuguugcaauacggcagcuucugcacccagcucaacagagcccugacuggaaucgcaguggagcaggauaaaaauacacaggaaguuuuugcgcaagugaagcagauuuauaaaaccccgccuaucaaggacuucgggggauuuaacuucucgcagauuuuaccagaucccuccaaaccuucuaagaggagcuuuaucgaggaccugcuauucaauaagguaacucucgcugaugccgguuucauaaaacaauacggcgacugucugggggauaucgcagcccgugaccuuauuugcgcucagaaguuuaacggauugaccguccugcccccacuccugacagaugaaaugaucgcccaguauacgucagcauuacuggcuggcaccauuacgagugguuggacauucggggccggcgcggcccuucagaucccuuuugcuaugcaaauggcauaccgguucaauggaauaggcgugacccagaacguguuguaugagaaucagaaacucauugccaaccaguuuaacuccgcuaucgggaagauucaagacucucugagcuccacagccucagcacuaggaaaacugcaggacgucguuaaucagaacgcgcaggcccucaauacucuggugaagcaacuuagcaguaacuucggcgcuaucucuuccguauugaaugauauacugagccgauuagacaagguggaagccgagguccagaucgauagacucauuaccgguaggcugcagucgcuucaaacguacgugacacagcagcugauccgcgcagcugagauucgggccucagcaaacuuggccgcuaccaaaaugucugaaugcguucucgggcagaguaagagaguggacuuuuguggaaaaggcuaccaccugauguccuucccccaaagcgcgccacauggugucguguuucuacacguuacuuaugugccggcccaggagaagaauuucaccacagcuccugcaaucugccacgauggcaaagcccauuuucccagggaaggggucuucguaucuaacggaacucacugguuugugacccagcgcaauuucuacgagccacagauaauuacaacggacaacaccuucguuagcggcaauugugauguggucaucgggaucgugaacaauacuguauaugacccccugcaaccugagcucgauuccuuuaaggaagaacuggacaaauacuucaagaaccauacaucaccagauguggaccuuggagauauuaguggcaucaaugccagcgucguuaacauucagaaggaaauagaccgauugaaugagguggcuaaaaaccugaacgaaucuuuaaucgaccuccaggagcuggguaaguaugagcaguacauuaaauggcccugguauaucuggcuuggguuuauugcaggacugaucgccauagugauggucaccaucaugcuaugcuguaugacuuccugcuguucaugccucaagggcuguugcaguugugguagcugcugcaaauucgaugaagacgauuccgagccugugcugaagggcguuaaguugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12483 - RNA, 4094 nt, Artificial Sequence
  SARS-CoV-2/Australia/QLD02/2020__EPI_ISL_407896 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacaggaaguuuucgcgcaagugaagcagauuuauaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauacggcgacugucuuggggauaucgcagcccgugacuugauuugcgcucagaaguucaacggacugaccguccugcccccacucuuaacagaugaaaugaucgcccaguauacgucagcacugcuugcuggcaccauuacgagugguuggacauuuggggccggcgcggccuugcagaucccuuucgcuaugcaaauggcauaccgguuuaauggaauaggcgugacccagaacgugcucuaugagaaucagaaacugauugccaaccaguucaacuccgcuaucgggaagauucaagacucucuaagcuccacagccucagcacugggaaaacuccaggacgucguuaaucagaacgcgcaggcccugaauacucuugugaagcaauugagcaguaacuuuggcgcuaucucuuccguacugaaugauauauuaagccgacucgacaagguggaagccgagguccagaucgauagacugauuaccgguaggcuucagucgcugcaaacguacgugacacagcaguugauccgcgcagcugagauucgggccucagcaaaccucgccgcuaccaaaaugucugaaugcguucuggggcagaguaagagaguggacuucuguggaaaaggcuaccaccuaauguccuuuccccaaagcgcgccacauggugucguguuccugcacguuacuuaugugccggcccaggagaagaauuuuaccacagcuccugcaaucugccacgauggcaaagcccauuuccccagggaaggggucuuuguaucuaacggaacucacugguucgugacccagcgcaauuuuuacgagccacagauaauuacaacggacaacaccuucguuagcggcaauugugauguggucaucgggaucgugaacaauacuguauaugacccccuccaacuggagcuugauuccuucaaggaagaguuggacaaauacuuuaagaaccauacaucaccugauguggaccugggagauauuaguggcaucaaugccagcgucguuaacauucagaaggaaauagaccgauuaaaugagguggcuaaaaaccucaacgaaucucugaucgaccuucaggagcuggguaaguaugagcaguacauuaaauggccaugguauaucuggcuaggguucauugcaggacucaucgccauagugauggucaccaucaugcugugcuguaugacuuccugcuguucaugcuugaagggcuguugcaguugugguagcugcugcaaauuugaugaagacgauuccgagcccgugcugaagggcguuaaguuacacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12484 - RNA, 4094 nt, Artificial Sequence
  SARS-CoV-2/India/1-31/2020__EPI_ISL_413523 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacaggaaguuuucgcgcaagugaagcagauuuauaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauacggcgacugucuuggggauaucgcagcccgugacuugauuugcgcucagaaguucaacggacugaccguccugcccccacucuuaacagaugaaaugaucgcccaguauacgucagcacugcuugcuggcaccauuacgagugguuggacauuuggggccggcgcggccuugcagaucccuuucgcuaugcaaauggcauaccgguuuaauggaauaggcgugacccagaacgugcucuaugagaaucagaaacugauugccaaccaguucaacuccgucaucgggaagauucaagacucucuaagcuccacagcuucagcccugggaaaacuccaggacguugugaaucagaacgcacaggcgcugaauacucuuguaaagcaauugagcaguaacuuuggcgccaucucuuccgugcugaaugauauauuaagccgacucgacaaggucgaagcugaggugcagaucgauagacugauuaccgguaggcuucagucgcugcaaacguacguuacacagcaguugauccgcgccgcagagauucgggcuucagccaaccucgcagccaccaaaaugucugaaugcgugcuggggcagaguaagagagucgacuucuguggaaaaggcuaccaccuaauguccuuuccccaaagcgcuccacauggugugguuuuccugcacgugacuuaugucccggcgcaggagaagaauuuuaccacagccccugcaaucugccacgauggcaaagcucauuuccccagggaagggguauuugugucuaacggaacucacugguucguuacccagcgcaauuuuuacgagccacagauaauuacaacggacaacaccuucgugagcggcaauugugaugucgugaucgggaucguaaacaauacuguguaugacccccuccaaccugagcuggauuccuucaaggaggaacuugacaaauacuuuaagaaccauacaucaccagaugucgacuugggagauauuaguggcaucaaugccagcguugugaacauucagaaggaaauagaccgacugaaugagguggccaaaaacuuaaacgaaucucucaucgaccugcaggagcuugguaaguaugagcaguacauuaaauggcccugguauaucuggcugggguucauugcuggacuaaucgcaauagucauggugaccaucaugcucugcuguaugacuuccugcuguucaugccugaagggcuguugcaguugugguagcugcugcaaauuugaugaagacgauuccgagccuguuuugaagggcguaaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12485 - RNA, 4094 nt, Artificial Sequence
  SARS-CoV-2/Guangdong/GD2020087-P0008/2020__EPI_ISL_413863 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggaaucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcgggagaucgcacccgggcagacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugaaagagauauauccaccgagaucuaccaagcgggaagcacacccuguaacgguguugaaggcuucaauugcuacuuuccacugcagucuuauggguuccagccuaccaacggagugggcuaccaacccuauaggguagucguguugucauuugagcuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacagacccuggaaauccuugacauaacuccgugcuccuucgggggagugucuguuauuacacccgguacgaauaccucgaaccaagucgcuguguuguaccaggacgugaauuguacugaggucccuguugccauccacgcagaucagcugacaccaaccuggcgcguguauagcacaggcuccaacguguuucagacuagagccgggugccucaucggagcugaacauguaaacaauucauacgagugugacauucccaucggcgcggguauuugcgcaaguuaucaaacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagagauucuucccgugucuaugacuaagaccuccgucgauuguacgauguauauaugcggcgacucaacagaguguaguaaucuguugcuccaguacggcagcuuuugcacccaacugaacagagccuuaacuggaaucgcaguggaacaggauaaaaauacacaggagguuuucgcacaggugaagcaaauuuauaaaaccccgccuaucaaggacuuugggggauucaacuuuucgcagauucugccagaucccuccaaaccuucuaagaggagcuucaucgaagaccuacucuuuaauaagguaacucuggcugaugccgguuucauaaaacaguacggcgacugucuuggggauaucgcagcccgugacuugauuugcgcucaaaaguucaacggacugaccguccugcccccacucuuaacagaugagaugaucgcccaguauacgucagcacugcuugcuggcaccauuacgagugguuggacauuuggggccggcgcggccuugcagaucccuuucgcuaugcagauggcauaccgguuuaauggaauaggcgugacccaaaacgugcucuaugaaaaucagaaacugauugccaaccaguucaacuccgcuaucgggaagauucaggacucucuaagcuccacagccucagcacugggaaaacuccaagacgucguuaaucagaacgcgcaggcccugaauacucuugugaagcaguugagcaguaacuuuggcgcuaucucuuccguacugaaugauauauuaagccgacucgacaagguggaggccgagguccaaaucgauagacugauuaccgguaggcuucagucgcugcagacguacgugacacaacaguugauccgcgcagcugaaauucgggccucagcaaaccucgccgcuaccaaaaugucugagugcguucuggggcagaguaagagaguggacuucuguggaaaaggcuaccaccuaauguccuuuccccagagcgcgccacauggugucguguuccugcacguuacuuaugugccggcccaagaaaagaauuuuaccacagcgccugcuaucugccacgauggcaaagcccauuuccccagggagggggucuuuguaucuaacggaacucacugguucgugacccagcgcaauuuuuacgagccacagauaauuacaacggacaacaccuucguuagcggcaauugugauguggucaucgggaucgugaacaauacuguauaugacccccuccagccugaacuggauuccuucaaggaggaacuugacaaauacuuuaagaaccauacaucaccagauguggacuugggagauauuaguggcaucaaugccagcgucguuaacauucaaaaggagauagaccgacugaaugaaguggcuaaaaacuuaaacgagucucucaucgaccugcaggagcuugguaaguaugaacaguacauuaaauggcccugguauaucuggcugggguucauugcaggacuaaucgccauagugauggucaccaucaugcucugcuguaugacuuccugcuguucaugccugaagggcuguugcaguugugguagcugcugcaaauuugaugaggacgauuccgaaccuguguugaagggcguuaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12486 - RNA, 4094 nt, Artificial Sequence
  SARS-CoV-2/Sweden/01/2020__EPI_ISL_411951 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacaggaaguuuucgcgcaagugaagcagauuuauaaaaccccgccuaucaaggacugugggggauuuaacuucucgcagauucugccagaucccuccaaaccuucuaagaggagcuuuaucgaggaccuacucuucaauaagguaacucuggcugaugccgguuuuauaaaacaauacggcgacugccuuggggauaucgcagcccgugacuugauuugcgcucagaaguucaacggacugaccguccugcccccacucuuaacagaugaaaugaucgcccaguauacgucagcacugcuugcuggcaccauuacgagugguuggacauucggggccggcgcggccuugcagaucccuuuugcuaugcaaauggcauaccgguucaauggaauaggcgugacccagaacgugcucuaugagaaucagaaacugauugccaaccaguuuaacuccgcuaucgggaagauucaagacucucuaagcuccacagccucagcacugggaaaacuccaggacgucguuaaucagaacgcgcaggcccugaauacucuugugaagcaauugagcaguaacuucggcgcuaucucuuccguacugaaugauauauuaagccgacucgacaagguggaagccgagguccagaucgauagacugauuaccgguaggcuucagucgcugcaaacguacgugacacagcaguugauccgcgcagcugagauucgggccucagcaaaccucgccgcuaccaaaaugucugaauguguucuggggcagaguaagagaguggacuuuugcggaaaaggcuaccaccuaauguccuucccccaaagcgcgccacauggugucguguuucugcacguuacuuaugugccggcccaggagaagaauuucaccacagcuccugcaaucugucacgauggcaaagcccauuuucccagggaaggggucuucguaucuaacggaacucacugguuugugacccagcgcaauuucuacgagccacagauaauuacaacggacaacaccuuuguuagcggcaauugcgauguggucaucgggaucgugaacaauacuguauaugacccccuccaaccugagcuggauuccuucaaggaggaacuugacaaauacuucaagaaccauacaucaccagauguggacuugggagauauuaguggcaucaaugccagcgucguuaacauucagaaggaaauagaccgacugaaugagguggcuaaaaacuuaaacgaaucucucaucgaccugcaggagcuugguaaguaugagcaguacauuaaauggcccugguauaucuggcugggguuuauugcaggacuaaucgccauagugauggucaccaucaugcucuguugcaugacuuccuguugcucaugucugaagggcugcuguaguugcgguagcugcuguaaauucgaugaagacgauuccgagccuguguugaagggcguuaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12487 - RNA, 4094 nt, Artificial Sequence
  SARS-CoV-2/Tianmen/HBCDC-HB-07/2020__EPI_ISL_412983 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggaccugaauuguacugaagugccugucgccauccacgcagaucagcucacaccaaccuggcgcguuuauagcacaggcuccaacguguuucaaacuagagccgggugccugaucggagcugagcaugugaacaauucauacgaaugugacauucccaucggcgcggguauuugcgcaaguuaucagacccagacgaacucuccuaggcgggcccgcagcguagcuucccagucaauaaucgccuacaccaugagccuuggggcagaaaauucugucgccuacuccaacaauaguauugcuaucccaacaaacuucacuaucagcgugaccacagaaauucugcccguuucuaugacuaagaccuccguggauuguacgauguauauaugcggcgacucaacagaguguaguaauuugcuccugcaauacggcagcuuuugcacccaguuaaacagagcccugacuggaaucgcagucgagcaggauaaaaauacacaggaaguguucgcgcaaguuaagcagauuuauaaaaccccgccuaucaaggacuuugggggauucaacuuuucgcagauucuaccagaucccuccaaaccuucuaagaggagcuucaucgaggaccuccuguuuaauaaggugacucuugcugaugccgguuucauaaaacaauacggcgacuguuugggggauaucgcagcccgugaccugauuugcgcucagaaguucaacggacucaccguacugcccccauuacugacagaugaaaugaucgcccaguauacgucagcacuuuuggcuggcaccauuacgagugguuggacauuuggggccggcgcggcccuccagaucccuuucgcuaugcaaauggcauaccgguuuaauggaauaggcgucacccagaacgugcuguaugagaaucagaaacuaauugccaaccaguucaacuccgcuaucgggaagauucaagacucucugagcuccacagccucagcacucggaaaacugcaggacguggucaaucagaacgcgcaggcccuuaauacuuugguuaagcaacugagcaguaacuuuggcgcuaucucuuccguguuaaaugauauacucagccgacuggacaagguagaagccgaggugcagaucgauagacuuauuaccgguaggcugcagucguugcaaacguacgucacacagcagcucauccgcgcagcugagauucgggccucagcaaaccuggccgcuaccaaaaugucugaaugcgugcuagggcagaguaagagaguugacuucuguggaaaaggcuaccaccugauguccuuuccccaaagcgcgccacaugguguggucuuccuccacgugacuuauguuccggcccaggagaagaauuuuaccacagcuccugcaaucugccacgauggcaaagcccauuuccccagggaagggguguuugucucuaacggaacucacugguucguaacccagcgcaauuuuuacgagccacagauaauuacaacggacaacaccuucgugagcggcaauugugauguugugaucgggaucgucaacaauacuguguaugacccccugcaaccugagcuugauuccuucaaggaagaguuggacaaauacuuuaagaaccauacaucaccagauguagaccugggagauauuaguggcaucaaugccagcguggucaacauucagaaggaaauagaccgauuaaaugagguugcuaaaaaccucaacgaaucucugaucgaccuucaggagcuggguaaguaugagcaguacauuaaauggcccugguauaucuggcuaggguucauugcaggacucaucgccauagugauggugaccaucaugcugugcuguaugacuuccugcuguucaugcuugaagggcuguugcaguugugguagcugcugcaaauuugaugaagacgauuccgagccuguccugaagggcgugaaguuacacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12488 - RNA, 4094 nt, Artificial Sequence
  SARS-CoV-2/Hong Kong/case42_VM20002493/2020__EPI_ISL_414527 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacgaauagcuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucgccaucagcguuacuaccgaaauucuucccgugucuaugacaaagacuuccgucgauuguaccauguauauaugcggcgacucaacggaguguaguaaucuguugcuccaauacggaucuuuuugcacacagcugaacagagcauuaaccggcaucgcgguggagcaggauaaaaauacucaggaaguuuucgcucaagugaagcagauuuauaaaacaccgccuaucaaggacuuugggggauucaacuuuucgcagauucugccagaucccuccaaaccuucuaagaggagcuucaucgaggaccuacucuuuaauaagguaacccuggccgaugcagguuucauaaaacaauacggcgacugucuuggggauaucgccgcucgugacuugauuugcgcccagaaguucaacggacugacuguccugcccccacucuuaaccgaugaaaugaucgcacaguauacaucagcucugcuugccggcacgauuaccagugguuggacuuuuggggcgggcgccgcuuugcagaucccuuucgcaaugcaaauggccuaccgguuuaauggaauaggcgugacacagaacgugcucuaugagaaucagaaacugauugcuaaccaguucaacuccgccaucgggaagauucaagacucucuaagcuccaccgcaucagcgcugggaaaacuccaggacgucguuaaucagaacgcccaggcucugaauacacuugugaagcaauugagcaguaacuuuggcgccaucucuuccguacugaaugauauauuaagccgacucgacaagguggaagcagagguccagaucgauagacugauuacugguaggcuucagucgcugcaaaccuacgugacgcagcaguugauccgcgcugccgagauucgggcaucagccaaccucgcugcgacaaaaaugucugaaugcguucuggggcagaguaagagaguggacuucuguggaaaaggcuaccaccuaauguccuuuccccaaagcgccccacauggugucguguuccugcacguuaccuaugugccggcacaggagaagaauuuuacuaccgcuccugccaucugccacgauggcaaagcccauuuccccagggaaggggucuuuguaucuaacggaacacacugguucgugacucagcgcaauuuuuacgagccacagauaauuaccacagacaacacguucguuagcggcaauugugauguggucaucgggaucgugaacaauaccguauaugacccccuccaaccugagcuggauuccuucaaggaggaacuugacaaauacuuuaagaaccauacuucaccagauguggacuugggagauauuaguggcaucaaugcuagcgucguuaacauucagaaggaaauagaccgacugaaugagguggccaaaaacuuaaacgaaucucucaucgaccugcaggagcuugguaaguaugagcaguacauuaaauggcccugguauaucuggcugggguucauugcaggacuaaucgcgauagugauggucacaaucaugcucugcuguaugaccuccugcuguucaugccugaagggcuguugcaguugugguagcugcugcaaauuugaugaagacgauuccgagccuguguugaagggcguuaagcugcacuacacuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12489 - RNA, 4094 nt, Artificial Sequence
  SARS-CoV-2/USA/CruiseA-23/2020__EPI_ISL_414482 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaagucaagcagggcaauuuuaaaaaccucagagaguucguuuuuaagaacauugaugguuacuucaaaaucuacaguaagcacaccccaauaaauuuagugagggaccugccccagggguuuagcgcucuugagccuuugguagaucugccaaucggaauuaacaucacacgguuccagacucuacucgcccugcaucgcucuuaucuuaccccgggcgacuccucaagcggcuggacagcaggggccgcugcauacuaugugggauaccugcaacccagaaccuuuuugcucaaauauaaugaaaacgguacgauuacugaugccgucgacugcgcucuggauccuuuaagugagacaaaguguacccugaagucuuucacuguggaaaaaggcaucuaccagacauccaauuuuaggguucagccaaccgagagcauagugcgguuccccaacauuacgaaucucugcccuuuuggggaggucuucaacgccacccgcuucgcgucgguguaugcauggaaucgaaagagaaucucuaacuguguagccgacuacuccguucuuuacaauucagcuaguuuuagcacauucaaaugcuauggaguguccccaacuaagcugaacgacuuguguuuuaccaaugucuacgccgauucuuucgugauuaggggcgacgaaguccggcagaucgcacccggucaaacagggaaaaucgcugauuauaacuacaagcuaccggacgauuuuacuggaugcgugauugccuggaauagcaacaaccuggacucaaaaguuggcggcaauuauaacuaccucuaucgucuguuccgcaagaguaaucuuaagccuuuugagagagauauauccaccgaaaucuaccaggcggggagcacacccuguaacggaguggaggguuucaauugcuacuuuccacugcagucuuauggcuuccaaccuaccaacgggguaggauaccagcccuauagggucgugguuuugucauuugaacuccugcacgccccagcaacugugugcggccccaaaaagaguacgaauuuagucaaaaacaagugugugaauuucaacuuuaauggucugacagggaccggcguacuaacugagagcaacaaaaaguuccucccuuuccagcaguuuggacgggacauugcugauaccacagacgccgugcgagauccacaaacccuggagauccuugacauaacuccgugcuccuucggcgggguuucugucauuacacccggaacgaauaccucgaaccagguggcuguguuguaccaggacgucaauuguacugaaguuccuguggccauccacgcagaucagcugacaccaaccuggcgcguguauagcacagguuccaacguauuucaaacuagagccggcugccucaucggggcugagcaugucaacaauucauacgaaugugacauucccaucggagcgggcauuugcgcaaguuaucagacccagacgaacucuccuaggcgggcccgcagcguggcuucccagucaauaaucgccuacaccaugagccugggugcagaaaauucuguugccuacuccaacaauaguauugcuaucccaacaaacuucacuaucagcgugaccacagaaauucuucccgucucuaugacuaagaccuccguggauuguacgauguauauaugcggggacucaacagaguguaguaaucuguugcuccaauacggcagcuuuugcacccagcugaacagagccuuaacuggaaucgcaguugagcaggauaaaaauacacaggaaguguucgcgcaaguaaagcagauuuauaaaaccccgccuaucaaggacuuuggcggguucaacuuuucgcagauucugccagaucccuccaaaccuucuaagaggagcuucaucgaggaccuacucuuuaauaaggucacucuggcugaugccggauucauaaaacaauacggugacugucuuggcgauaucgcagcccgugacuugauuugcgcucagaaguucaacgggcugaccgugcugcccccacucuuaacagaugaaaugaucgcccaguauacgucagcacugcuugcuggaaccauuacgaguggcuggacauuuggugccggggcggccuugcagaucccuuucgcuaugcaaauggcauaccgguuuaauggcauaggagugacccagaacguccucuaugagaaucagaaacugauugccaaccaguucaacuccgcuaucggcaagauucaagacucucuaagcuccacagccucagcacuggggaaacuccaggacguugugaaucagaacgcgcaggcccugaauacucuuguaaagcaauugagcaguaacuuuggagcuaucucuuccgugcugaaugauauauuaagccgacucgacaaggucgaagccgaggugcagaucgauagacugauuaccggcaggcuucagucgcugcaaacguacguuacacagcaguugauccgcgcagcugagauucgggccucagcaaaccucgccgcuaccaaaaugucugaaugcgugcugggucagaguaagagagucgacuucugugggaaaggauaccaccuaauguccuuuccccaaagcgcgccacauggcgugguuuuccugcacgugacuuaugucccggcccaggagaagaauuuuaccacagcuccugcaaucugccacgaugguaaagcccauuuccccagggaaggcguauuugugucuaacgggacucacugguucguuacccagcgcaauuuuuacgagccacagauaauuacaacggacaacaccuucgugagcggaaauugugaugucgugaucggcaucguaaacaauacuguguaugacccccuccaaccugagcuggauuccuucaaggaagaacuugacaaauacuuuaagaaccauacaucaccagaugucgacuugggggauauuaguggaaucaaugccagcguugugaacauucagaaggaaauagaccgacugaaugagguggcuaaaaacuuaaacgaaucucucaucgaccugcaggagcuuggcaaguaugagcaguacauuaaauggcccugguauaucuggcuggguuucauugcagggcuaaucgccauagucauggugaccaucaugcucugcuguaugacuuccugcuguucaugccugaagggauguugcaguuguggcagcugcugcaaauuugaugaagacgauuccgagccuguuuugaaggguguaaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12490 - RNA, 4094 nt, Artificial Sequence
  SARS-CoV-2/Hong Kong/case85_VM20002868/2020__EPI_ISL_414519 spike protein mRNA human (1-1273)
aggagagucccgcagucggcguccagcggcucugcuuguucgugugugugucguugcaggccuuauucaagcuuaccauguucguguuucugguccucguuccccuugugagcucccagugcguaaaccugaccacaagaacucaauugccuccagccuacacuaauucuuucaccaggggcguguauuacccggacaaggucuuucggucaaguguguuacacagcacacaggaucuguuccuacccuuuuucuccaacguuacuugguuucaugcuauccacgugucugggaccaauggaacaaaacgcuucgacaacccuguccucccauuuaaugaugguguguauuucgcaucgaccgagaagucaaacauuauacgaggcuggaucuuugggacuacacuggacagcaaaacccagagucuucugauuguaaauaacgccacgaauguugugaucaaggucugugaguuccaguuuugcaacgaucccuucuugggaguguacuaucauaaaaauaacaaguccuggauggagucugaguuccguguguacagcuccgcgaauaacuguacuuuugaauaugucucacaaccuuuccucauggaccuggaaggcaagcaggguaauuuuaaaaaccugagagaguucguuuuuaagaacauugauggguacuucaaaaucuacaguaagcacaccccaauaaaucucgugagggacuuaccccagggauuuagcgcucuggagccucuuguagauuugccaaucggcauuaacaucacacgguuccagacucugcuagcccuccaucgcucuuaucugaccccgggcgacuccucaagcggguggacagcaggagccgcugcauacuauguggguuaccuucaacccagaaccuuucuguugaaauauaaugaaaacggcacgauuacugaugccgucgacugcgcucucgauccucugagugagacaaaguguaccuuaaagucuuucacuguggaaaaagggaucuaccagacauccaauuuuaggguucagccaaccgagagcauagugcgguuccccaacauuacgaaucugugcccuuuuggagaggucuucaacgccacccgcuucgcgucgguguaugcauggaaucgaaagagaaucucuaacuguguagccgacuacuccguucucuacaauucagcuaguuuuagcacauucaaaugcuauggcguguccccaacuaaacuuaacgaccuguguuuuaccaaugucuacgccgauucuuucgugauuaggggugacgaaguccggcagaucgcacccgggcaaacaggaaagaucgcugauuauaacuacaaguugccggacgauuuuacuggcugcgugauugccuggaauagcaacaaccuagacucaaaaguuggcgggaauuauaacuaccuguaucgucucuuccgcaagaguaaucugaagccuuuugagagagauauauccaccgaaaucuaccaggcgggaagcacacccuguaacgguguggagggcuucaauugcuacuuuccacuucagucuuauggguuccaaccuaccaacggaguaggcuaccagcccuauagggucgugguucugucauuugaauugcuccacgccccagcaacugugugcggucccaaaaagaguacgaaucuggucaaaaacaagugugugaauuucaacuuuaauggguuaacaggcaccggaguacugacugagagcaacaaaaaguuccuaccuuuccagcaguuuggccgggacauugcugauaccacagacgccgugcgagauccacaaacccucgagauccuggacauaacuccgugcuccuucgggggaguuucugucauuacacccgguacgaauaccucgaaccagguggcugugcuuuaccaggacgucaauuguacugaaguuccuguggccauccacgcagaucaguugacaccaaccuggcgcguguauagcacaggcuccaacguauuucaaacuagagccgggugccugaucggagcugagcaugucaacaauucauacgaaugugacauucccaucggcgcggguauuugcgcaaguuaucagacccagacgaacucuccuaggcgggcccgcagcguggcuucccagucaauaaucgccuacaccaugagccucggggcagaaaauucuguugccuacuccaacaauaguauugcuaucccaacaaacuucacuaucagcgugaccacagaaauucugcccgucucuaugacuaagaccuccguggauuguacgauguauauaugcggcgacucaacagaguguaguaaucuucuguugcaauacggcagcuuuugcacccagcucaacagagcccugacuggaaucgcaguugagcaggauaaaaauacacaggaaguguucgcgcaaguaaagcagauuuauaaaaccccgccuaucaaggacuuugggggauucaacuuuucgcagauuuuaccagaucccuccaaaccuucuaagaggagcuucaucgaggaccugcuauuuaauaaggucacucucgcugaugccgguuucauaaaacaauacggcgacugucugggggauaucgcagcccgugaccuuauuugcgcucagaaguucaacggauugaccgugcugcccccacuccugacagaugaaaugaucgcccaguauacgucagcauuacuggcuggcaccauuacgagugguuggacauuuggggccggcgcggcccuucagaucccuuucgcuaugcaaauggcauaccgguuuaauggaauaggcgugacccagaacgucuuguaugagaaucagaaacucauugccaaccaguucaacuccgcuaucgggaagauucaagacucucugagcuccacagccucagcacuaggaaaacugcaggacguugugaaucagaacgcgcaggcccucaauacucugguaaagcaacuuagcaguaacuuuggcgcuaucucuuccguguugaaugauauacugagccgauuagacaaggucgaagccgaggugcagaucgauagacucauuaccgguaggcugcagucgcuucaaacguacguuacacagcagcugauccgcgcagcugagauucgggccucagcaaacuuggccgcuaccaaaaugucugaaugcgugcucgggcagaguaagagagucgacuucuguggaaaaggcuaccaccugauguccuuuccccaaagcgcgccacauggugugguuuuccuacacgugacuuaugucccggcccaggagaagaauuuuaccacagcuccugcaaucugccacgauggcaaagcccauuuccccagggaagggguauuugugucuaacggaacucacugguucguuacccagcgcaauuuuuacgagccacagauaauuacaacggacaacaccuucgugagcggcaauugugaugucgugaucgggaucguaaacaauacuguguaugacccccugcaaccugagcucgauuccuucaaggaggaacuggacaaauacuuuaagaaccauacaucaccagaugucgaccuuggagauauuaguggcaucaaugccagcguugugaacauucagaaggaaauagaccgauugaaugagguggcuaaaaaccugaacgaaucuuuaaucgaccuccaggagcuggguaaguaugagcaguacauuaaauggcccugguauaucuggcuuggguucauugcaggacugaucgccauagucauggugaccaucaugcuaugcuguaugacuuccugcuguucaugccucaagggcuguugcaguugugguagcugcugcaaauuugaugaagacgauuccgagccuguucugaagggcguaaaguugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12491 - RNA, 4094 nt, Artificial Sequence
  SARS-CoV-2/England/200990660/2020__EPI_ISL_414523 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgcagcccgugauuugauuugcgcucagaaguucaacggccugaccguccugcccccacucuuaacagacgaaaugaucgcccaguauacgucagcacugcuugcugguaccauuacgaguggguggacauuuggcgccggagcggccuugcagaucccuuucgcuaugcaaauggcauaccgguuuaauggcauaggggugacccagaacgugcucuaugagaaucagaaacugauugccaaccaguucaacuccgcuaucggaaagauucaagauucucuaagcuccacagccucagcacugggcaaacuccaggacgucguuaaucagaacgcgcaggcccugaauacucuugugaagcaauugagcaguaacuuuggugcuaucucuuccguacugaaugacauauuaagccgacucgauaagguggaagccgagguccagaucgacagacugauuaccgggaggcuucagucgcugcaaacguacgugacacagcaguugauccgcgcagcugagauucgggccucagcaaaccucgccgcuaccaaaaugucugaaugcguucugggacagaguaagagaguggauuucuguggcaaagguuaccaccuaauguccuuuccccaaagcgcgccacauggcgucguguuccugcacguuacuuaugugccggcccaggagaagaauuuuaccacagcuccugcaaucugccacgacgggaaagcccauuuccccagggaaggagucuuuguaucuaacggcacucacugguucgugacccagcgcaauuuuuacgagccacagauaauuacaacggauaacaccuucguuagcgggaauugugacguggucaucggaaucgugaacaauacuguauaugauccccuccaaccugagcuggacuccuucaaggaagaacuugauaaauacuuuaagaaccauacaucaccagacguggauuugggcgacauuagugguaucaaugccagcgucguuaacauucagaaggaaauagaucgacugaaugagguggcuaaaaacuuaaacgaaucucucaucgaccugcaggagcuugggaaguaugagcaguacauuaaauggcccugguauaucuggcugggauucauugcaggccuaaucgccauagugauggucaccaucaugcucugcuguaugacuuccugcuguucaugccugaaggguuguugcaguuguggcagcugcugcaaauuugacgaagaugacuccgaguuggugcugaaggggguuaaguuacacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12492 - RNA, 4094 nt, Artificial Sequence
  SARS-CoV-2/Australia/NSW09/2020__EPI_ISL_413595 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacaggaaguuuucgcgcaagugaagcagauuuauaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauacggcgacugucuuggggauaucgcagcccgugacuugauuugcgcucagaaguucaacggacugaccguccuacccccacuguuaacagaugaaaugaucgcccaguauacgucagcacugcuugcuggcaccauuacgagugguuggacauuuggggccggcgcggccuugcagaucccuuucgcuaugcaaauggcauaccgguuuaauggaauaggcgugacccagaacgugcucuaugagaaucagaaacugauugccaaccaguucaacuccgcuaucgggaagauucaagacucucucagcuuuacagccuccgcacugggaaaacuccaggacgucguuaaucagaacgcgcaggcccugaauacucuugugaagcaauugucaagcaacuucggcgcuaucaguucuguacugaaugauauauuaucccgacucgacaagguggaagccgagguccagaucgauagacugauuaccgguaggcuucagagccugcaaacguacgugacacagcaguugauccgcgcagcugagauucgggccucggcaaaccucgccgcuaccaaaaugucagaaugcguucuggggcagucuaagagaguggacuuuuguggaaaaggcuaccaccuaaugaguuucccccaauccgcgccacauggugucguguuucugcacguuacuuaugugccggcccaggagaagaauuucaccacagcuccugcaaucugccacgauggcaaagcccauuuucccagggaaggggucuucguaagcaacggaacucacugguuugugacccagcgcaauuucuacgagccacagauaauuacaacggacaacaccuucguuucuggcaauugugauguggucaucgggaucgugaacaauacuguauaugacccccuccaaccugagcuggauagcuuuaaggaggaacuugacaaauacuucaagaaccauacauccccagauguggacuugggagauauuucaggcaucaaugccagugucguuaacauucagaaggaaauagaccgacugaaugagguggcuaaaaacuuaaacgaaagccucaucgaccugcaggagcuugguaaguaugagcaguacauuaaauggcccugguauaucuggcugggguuuauugcaggacuaaucgccauagugauggucaccaucaugcucugcuguaugacuucuugcuguuccugccugaagggcuguugcucaugugguaguugcugcaaauucgaugaagacgauagcgagccuguguugaagggcguuaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12493 - RNA, 4094 nt, Artificial Sequence
  SARS-CoV-2/Australia/NSW10/2020__EPI_ISL_413596 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacaggaaguuuucgcgcaagugaagcagauuuauaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauacggcgacugucuuggggauaucgcagcccgugacuugauuugcgcucagaaguucaacggacugaccguccugcccccacucuuaacagaugaaaugaucgcccaguauacgucagcacugcuugcuggcaccauuacgagugguuggacauuuggggccggcgcggccuugcagaucccuuucgcuaugcaaauggcauaccgguuuaauggaauaggcgugacccagaacgugcucuaugagaaucagaaacugauugccaaccaguucaacuccgcuaucgggaagauucaagacucucuaagcuccacagccucagcacugggaaaacuccaggacgucguuaaucagaacgcgcaggcccugaauacucuugugaagcaauugagcaguaacuuuggcgcuaucucuuccguacugaaugauauauuaagccgacucgacaagguggaagccgagguccagaucgauagacugauuaccgguaggcuucagucgcugcaaacguacgugacacagcaguugauccgcgcagcugagauucgggccucagcaaaccucgccgcuaccaaaaugucugaaugcguucuggggcagaguaagagaguggacuucuguggaaaaggcuaccaccuaauguccuuuccccaaagcgcgccacauggugucguguuccugcacguuacuuaugugccggcccaggagaagaauuuuaccacagcuccugcaaucugccacgauggcaaagcccauuuccccagggaaggggucuuuguaucuaacggaacucacugguucgugacccagcgcaauuuuuacgagccacagauaauuacaacggacaacaccuucguuagcggcaauugugauguggucaucgggaucgugaacaauacuguauaugacccccuccaaccugagcuggauuccuucaaggaggaacuugacaaauacuuuaagaaccauacaucaccagauguggacuugggagauauuaguggcaucaaugccagcgucguuaacauucagaaggaaauagaccgacugaaugagguggcuaaaaacuuaaacgaaucucucaucgaccugcaggagcuugguaaguaugagcaguacauuaaauggcccugguauaucuggcugggguucauugcaggacuaaucgccauagugauggucaccaucaugcucugcuguaugacuuccugcuguucaugccugaagggcuguugcaguugugguagcugcuuuaaauucgaugaagacgauuccgagccuguguugaagggcguuaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12494 - RNA, 4094 nt, Artificial Sequence
  SARS-CoV-2/Switzerland/1000477797/2020__EPI_ISL_413023 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaauaucuacaguaaacacaccccaauaaacuuaguuagggaccugccccagggauuuagcgcucuugagccuuugguggaucugccaaucggcauuaauaucacacgguuccagacucuacucgcccugcaucgcucuuaucuuaccccgggcgacuccucaagcggguggacagcaggagccgcugcauacuauguagguuaccugcaacccagaaccuuuuugcucaaguauaacgaaaauggcacgauuacugaugccguggacugcgcucuggauccuuuaagugagacaaaauguacccugaagucuuucacugucgaaaaggggaucuaccagacauccaacuuuagggugcagccaaccgagagcauaguucgguuccccaauauuacgaaccucugcccuuuuggagagguguucaaugccacccgcuucgcgucggucuaugcauggaaccgaaaaagaaucucuaauuguguggccgacuacuccguacuuuacaacucagcuaguuuuagcacauucaagugcuauggcguuuccccaacuaaacugaaugacuuguguuuuaccaacguguacgccgauucuuucgucauuaggggugacgaagugcggcagaucgcacccgggcaaacaggaaagaucgcugauuauaauuacaaacuaccggacgauuuuacuggcugcgucauugccuggaacagcaacaaucuggacucaaaggugggcgggaacuauaauuaccucuaucgucuguuccgcaaaaguaaccuuaagccuuuugagagagauauauccaccgaaaucuaccaggcgggaagcacacccuguaaugguguugagggcuucaacugcuacuuuccacugcagucuuauggguuccaaccuaccaauggagugggcuaccagcccuauaggguagucguguugucauuugaacuccugcacgccccagcaacuguuugcggucccaagaaaaguacgaacuuagugaagaauaaaugugucaacuucaauuuuaacgggcugacaggcaccggagugcuaacugagagcaauaagaaauuccucccuuuccagcaguuuggccgggacauugcugauaccacagacgccguacgagauccacaaacccuggagauccuugacauaacuccgugcuccuucgggggagugucuguuauuacacccgguacgaacaccucgaaucaggucgcuguguuguaccagggcgugaacuguacugaagucccuguugccauccacgcagaccagcugacaccaaccuggcgcguguauagcacaggguccaacguguuucaaacuagagccggaugccucaucggcgcugagcauguaaauaacucauacgaaugugauauucccaucggugcggggauuugcgcaaguuaucagacccagaccaauucuccuaggcgggcccgcagcgucgcuucccagucaauaaucgccuacacgaugagccugggcgcagagaacucuguggccuacuccaauaacaguauugcuaucccaacaaauuucacuaucagcguuaccacagaaauucuucccgugucuaugacuaagaccuccgucgacuguacgauguauauaugcggagauucaacagaguguaguaaccuguugcuccaauacggcagcuuuugcacccagcugaauagagccuuaacugggaucgcaguggagcaggacaagaacacacaggaaguuuucgcgcaagugaaacagauuuauaagaccccgccuaucaaagauuuuggagguuucaauuuuucgcagauucugccagaccccuccaagccuucuaaaaggagcuucaucgaggaucuacucuuuaacaagguaacucuggcugacgccggcuucauaaagcaauacggggauugucuuggagacaucgcagcccgugauuugauuugcgcucagaaauucaauggccugaccguccugcccccacucuuaacagacgaaaugaucgcccaguauacgucagcacugcuugcugguaccauuacgaguggguggacauuuggcgccggagcggccuugcagaucccuuucgcuaugcaaauggcauaccgguuuaacggcauaggggugacccagaaugugcucuaugagaaccagaagcugauugccaaccaguucaauuccgcuaucggaaaaauucaagauucucuaagcuccacagccucagcacugggcaagcuccaggacgucguuaaccagaaugcgcaggcccugaacacucuugugaaacaauugagcaguaauuuuggugcuaucucuuccguacugaacgacauauuaagccgacucgauaagguggaagccgagguccagaucgacagacugauuaccgggaggcuucagucgcugcaaacguacgugacacagcaguugauccgcgcagcugagauucgggccucagcaaaucucgccgcuaccaagaugucugaaugcguucugggacagaguaaaagaguggauuucuguggcaaggguuaccaccuaauguccuuuccccaaagcgcgccacauggcgucguguuccugcacguuacuuaugugccggcccaggagaaaaacuuuaccacagcuccugcaaucugccacgacgggaaggcccauuuccccagggaaggagucuuuguaucuaauggcacucacugguucgugacccagcgcaacuuuuacgagccacagauaauuacaacggauaauaccuucguuagcgggaacugugacguggucaucggaaucgugaauaacacuguauaugauccccuccaaccugagcuggacuccuucaaagaagaacuugauaaguacuuuaaaaaucauacaucaccagacguggauuugggcgacauuagugguaucaacgccagcgucguuaauauucagaaggaaauagaucgacugaacgagguggcuaagaacuuaaaugaaucucucaucgaccugcaggagcuugggaaauaugagcaguacauuaaguggcccugguauaucuggcugggauucauugcaggccuaaucgccauagugauggucaccaucaugcucugcuguaugacuuccugcuguucaugccugaaagguuguugcaguuguggcagcugcugcaaguuugacgaagaugacuccgagccuguguugaaagggguuaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12495 - RNA, 4094 nt, Artificial Sequence
  SARS-CoV-2/Belgium/BA-02291/2020__EPI_ISL_415159 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcagaaguaaucuuaagccuuuugagagggauauauccaccgaaaucuaccaggcgggaagcacacccuguaacgguguugagggcuucaauugcuacuuuccacugcagucuuauggguuccaaccuaccaacggagugggcuaccagcccuaucggguagucguguugucauuugaacuccugccagcccccgcaacuguuugcgguccuaagaaaaguacgaauuuagugaagaacaaaugugucaauuucaacuuuaaugggcugacaggcaccggagugcuaacugagagcaacaagaaauuccucccauuccagcaguuuggccgagacauugcugauaccacagacgccguacgcgauccgcaaacccuggagauccuugacauaacucccugcuccuucgggggagugucuguuauuacaccugguacgaauaccucgaaccaggucgcuguguuguaccagggcgugaauuguacugaagucccaguugccauccacgcagaccagcugacacccaccuggagaguguauagcacaggguccaacguguuucaaacuagggccggaugccucaucggcgcugagcacguaaacaauucauacgaaugugauauuccuaucggugcggggauuugcgcaaguuaucagacccagacgaacucuccacggcgcgccagaagcgucgcuucccagucaauaaucgccuacaccaugagccugggcgcagaaaauucuguggccuacuccaacaauaguauugcuauccccacaaacuucacuaucagcguuaccacagaaauucuuccggugucuaugacuaagaccuccgucgacuguacgauguauauaugcggagauucaacagaguguaguaaucuguugcuccaauacggcagcuuuugcacccagcugaacagggccuuaacugggaucgcaguggagcaggacaagaauacacaggaaguuuucgcgcaagugaaacagauuuauaagaccccuccaaucaaagauuuuggagguuucaacuuuucgcagauucugcccgacccuuccaagcccucuaaacguagcuucaucgaggaucuacucuuuaauaagguaacucuggcugacgccggcuucauaaagcaauacggggauugucuuggagacaucgcagcccgggauuugauuugcgcucagaaauucaacggccugaccguccucccaccucuguuaacagacgaaaugaucgcccaguauacgucagcacugcuugcugguaccauuacgaguggguggacauuuggcgccggagcggccuugcagauccccuucgcuaugcaaauggcauaccgauuuaauggcauaggggugacccagaacgugcucuaugagaaucagaagcugauugccaaccaguucaacuccgcuaucggaaaaauucaagauucucuaagcuccgccgcaccagcgcugggcaagcuccaggacgucguuaaucagaacgcccaggcucugaauacacuugugaaacaauugucaagcaacuuuggugccaucaguucuguacugaaugacauauuauccagacucgauaagguggaagcagagguccagaucgacaggcugauuacugggcgccuucagagccugcaaaccuacgugacgcagcaguugauccgggcugccgagauuagagcaucggccaaccucgcugcgacaaagaugucagaaugcguucugggacagucuaaaaggguggauuucuguggcaaggguuaccaucuaaugaguuuuccgcaauccgccccucacggcgucguguuccugcauguuaccuaugugcccgcacaggagaaaaauuuuacuaccgcuccagccaucugccacgacgggaaggcccacuucccccgcgaaggagucuuuguaagcaacggcacacauugguucgugacucagcgaaauuuuuacgagccucagauaauuaccacagauaacacguucguuucugggaauugugacguggucaucggaaucgugaacaauaccguauaugauccacuccaacccgagcuggacagcuucaaagaagaacuugauaaguacuuuaaaaaccacacuuccccugacguggauuugggcgacauuucagguaucaaugcuagugucguuaacauucagaaggaaauagaucggcugaaugagguggcaaagaacuuaaacgaaagccucaucgaccugcaggagcuugggaaauaugagcaguacauuaaguggccgugguauaucuggcugggauucauugccggccuaaucgcgauagugauggucacaaucaugcucugcuguaugaccucuugcuguuccugccugaaagguuguugcucauguggcaguugcugcaaguuugacgaagaugacagcgagccaguguugaaagggguuaagcugcauuacacuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12496 - RNA, 4094 nt, Artificial Sequence
  SARS-CoV-2/USA/WA8-UW5/2020__EPI_ISL_413486 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugaguacguaaacaauucauaugaaugugacauucccaucggcgcggguauuugcgcaaguuaccagacccagacgaacucuccuaggcgggcccgcagcgucgcuucccagucaauaaucgccuacaccaugagccugggggcagaaaauucuguggccuauuccaacaauaguauugcuaucccaacaaacuucacuaucagcguuaccacagaaauucuucccgugucuaugacuaagaccuccgucgauuguacgauguacauaugcggcgacucaacagaguguaguaaucuguugcuccaauauggcagcuuuugcacccagcugaacagagccuuaacuggaaucgcaguggagcaggauaaaaauacacaggaaguuuucgcgcaagugaagcagauuuacaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauauggcgacugucuuggggauaucgcagcccgugacuugauuugcgcucagaaguucaacggacugaccguccugcccccacucuuaacagaugaaaugaucgcccaguacacgucagcacugcuugcuggcaccauuacgagugguuggacauuuggggccggcgcggccuugcagaucccuuucgcuaugcaaauggcauaucgguuuaauggaauaggcgugacccagaacgugcucuacgagaaucagaaacugauugccaaccaguucaacuccgcuaucgggaagauucaagacucucuaagcuccacagccucagcacugggaaaacuccaggacgucguuaaucagaacgcgcaggcccugaauacucuugugaagcaauugagcaguaacuuuggcgcuaucucuuccguacugaaugauauauuaagccgacucgacaagguggaagccgagguccagaucgauagacugauuaccgguaggcuucagucgcugcaaacguacgugacacagcaguugauccgcgcagcugagauucgggccucagcaaaccucgccgcuaccaaaaugucugaaugcguucuggggcagaguaagagaguggacuucuguggaaaaggcuaucaucuaauguccuuuccccaaagcgcgccacacggugucguguuccugcauguuacuuacgugccggcccaggagaagaauuuuaccacagcuccugcaaucugccacgauggcaaagcccacuuccccagggaaggggucuuuguaucuaacggaacucauugguucgugacccagcgcaauuuuuaugagccacagauaauuacaacggacaacaccuucguuagcggcaauugugauguggucaucgggaucgugaacaauacuguauacgacccccuccaaccugagcuggauuccuucaaggaggaacuugacaaauauuuuaagaaccacacaucaccagauguggacuugggagauauuaguggcaucaaugccagcgucguuaacauucagaaggaaauagaccgacugaaugagguggcuaaaaacuuaaacgaaucucucaucgaccugcaggagcuugguaaguacgagcaguauauuaaauggcccugguacaucuggcugggguucauugcaggacuaaucgccauagugauggucaccaucaugcucugcuguaugacuuccugcuguucaugccugaagggcuguugcaguugugguagcugcugcaaauuugaugaagacgauuccgagccuguguugaagggcguuaagcugcauuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12497 - RNA, 4094 nt, Artificial Sequence
  SARS-CoV-2/England/20102000506/2020__EPI_ISL_415147 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggguauugucuuggagauaucgcagcccgugacuugauuugcgcucagaaguucaacggccugaccguccugcccccacucuuaacagaugaaaugaucgcccaguacacgucagcacugcuugcugguaccauuacgaguggguggacauuuggcgccggagcggccuugcagaucccuuucgcuaugcaaauggcauaucgguuuaauggcauaggggugacccagaacgugcucuacgagaaucagaaacugauugccaaccaguucaacuccgcuaucggaaagauucaagacucucuaagcuccacagccucagcacugggcaaacuccaggaugucguuaaucagaacgcgcaggcccugaauacucuugugaagcaauugagcaguaacuuuggugcuaucucuuccguacugaaugacauauuaagccgacucgacaagguggaagccgagguccagaucgauagacugauuaccgggaggcuucagucgcugcaaacguacgugacacagcaguugauccgcgcagcugagauucgggccucagcaaaccucgccgcuaccaaaaugucugaaugcguucugggacagaguaagagaguggacuucuguggcaaagguuaucaccuaauguccuuuccccaaagcgcgccacauggcgucguguuccugcacguuacuuacgugccggcccaggagaagaauuuuaccacagcuccugcaaucugccacgaugggaaagcccauuuccccagggaaggagucuuuguaucuaacggcacucacugguucgugacccagcgcaauuuuuaugagccacagauaauuacaacggacaacaccuucguuagcgggaauugugauguggucaucggaaucgugaacaauacuguauacgacccccuccaaccugagcuggauuccuucaaggaagaacuugacaaauauuuuaagaaccauacaucaccagauguggacuugggcgauauuagugguaucaaugccagcgucguuaacauucagaaggaaauagaccgacugaaugagguggcuaaaaacuuaaacgaaucucucaucgaucugcaggagcuugggaaguacgagcaguauauuaaauggcccugguacaucuggcugggauucauugcaggccuaaucgccauagugauggucaccaucaugcucugcuguaugacuuccugcuguucaugccugaaggguuguugcaguuguggcagcugcugcaaauuugacgaagacgauuccgagccuguguugaaggggguuaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12498 - RNA, 4094 nt, Artificial Sequence
  SARS-CoV-2/Belgium/VAG-03013/2020__EPI_ISL_415155 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgcagcccgugauuugauuugcgcucagaaguucaacggccugaccguccugcccccacucuuaacagacgaaaugaucgcccaguauacgucagcacugcuugcugguaccauuacgaguggguggacauuuggcgccggagcggccuugcagaucccuuucgcuaugcaaauggcauaccgguuuaauggcauaggggugacccagaacgugcucuaugagaaucagaaacugauugccaaccaguucaacuccgcuaucggaaagauucaagauucucuaagcuccacagccacugcacugggcaaacuccaggacgucguuaaucagaacgcgcaggcccugaauacccuugugaagcaauugucaagcaacuuuggugcuaucaguucuguacugaaugacauauuaucccgacucgauaagguggaagccgagguccagaucgacagacugauuacggggaggcuucagagccugcaaacauacgugacccagcaguugauccgcgcagcugagauucgggccucggcaaaccucgccgcuacuaaaaugucagaaugcguucugggacagucuaagagaguggauuucuguggcaaagguuaccaccuaaugaguuuuccccaauccgcgccacauggcgucguguuccugcacguuaccuaugugccggcccaggagaagaauuuuacaacugcuccugcaaucugccacgacgggaaagcccauuuccccagggaaggagucuuuguaagcaacggcacccacugguucgugacacagcgcaauuuuuacgagccacagauaauuacgaccgauaacacuuucguuucugggaauugugacguggucaucggaaucgugaacaauacaguauaugauccccuccaaccugagcuggacagcuucaaggaagaacuugauaaauacuuuaagaaccauaccuccccagacguggauuugggcgacauuucagguaucaaugccagugucguuaacauucagaaggaaauagaucgacugaaugagguggcuaaaaacuuaaacgaaagccucaucgaccugcaggagcuugggaaguaugagcaguacauuaaauggcccugguauaucuggcugggauucauugcaggccuaaucgccauagugauggucacuaucaugcucugcuguaugacaucuugcuguuccugccugaaggguuguugcucauguggcaguugcugcaaauuugacgaagaugacagcgagccuguguugaaggggguuaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12499 - RNA, 4094 nt, Artificial Sequence
  SARS-CoV-2/Belgium/BC-03016/2020__EPI_ISL_415157 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgcagcccgugauuugauuugcgcucagaaguucaacggccugaccguccugcccccacucuuaacagacgaaaugaucgcccaguauacgucagcacugcuugcugguaccauuacgaguggguggacauuuggcgccggagcggccuugcagaucccuuucgcuaugcaaauggcauaccgguuuaauggcauaggggugacccagaacgugcucuaugagaaucagaaacugauugccaaccaguucaacuccgcuaucggaaagauucaagauucucuaagcuccacagcccccgcacugggcaaacuccaggacgucguuaaucagaacgcgcaggcccugaauacucuugugaagcaauugucaagcaacuuuggugcuaucaguucuguacugaaugacauauuaucccgacucgauaagguggaagccgagguccagaucgacagacugauuaccgggaggcuucagagccugcaaacguacgugacacagcaguugauccgcgcagcugagauucgggccucggcaaaccucgccgcuaccaaaaugucagaaugcguucugggacagucuaagagaguggauuucuguggcaaagguuaccaccuaaugaguuuuccacaauccgcgccgcauggcgucguguuccugcacguuacuuaugugccugcccaggagaagaauuuuaccacagcacccgcuaucugccacgacgggaaagcccauuucccaagggaaggagucuuuguaagcaacggcacucacugguucgugacccagcgcaauuuuuacgagccccagauaauuacaacggauaacaccuucguuucugggaauugugacguggucaucggaaucgugaacaauacuguauaugauccucuccaaccagagcuggacagcuucaaggaagaacuugauaaauacuuuaagaaccauacaucccccgacguggauuugggcgacauuucagguaucaaugccagugucguuaacauucagaaggaaauagaucgacugaaugagguggcuaaaaacuuaaacgaaagccucaucgaccugcaggagcuugggaaguaugagcaguacauuaaauggccuugguauaucuggcugggauucauugcaggccuaaucgccauagugauggucaccaucaugcucugcuguaugacuucuugcuguuccugccugaaggguuguugcucauguggcaguugcugcaaauuugacgaagaugacagcgagccgguguugaaggggguuaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12500 - RNA, 4094 nt, Artificial Sequence
  SARS-CoV-2/Germany/BavPat3/2020__EPI_ISL_414521 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacagcaaguuuucgcacaggugaagcagauuuauaaaaccccgccuaucaaggacuuugggggauucaacuuuucgcaaauucugccagaucccuccaaaccuucuaagaggagcuucaucgaagaccuacucuuuaauaagguaacucuggcugaugccgguuucauaaaacaguacggcgacugucuuggggauaucgcagcccgugacuugauuugcgcucagaaguucaacggacugaccguccugcccccacucuuaacagaugagaugaucgcccaguauacgucagcacugcuugcuggcaccauuacgagugguuggacauuuggggccggcgcggccuugcaaaucccuuucgcuaugcagauggcauaccgguuuaauggaauaggcgugacccagaacgugcucuaugaaaaucagaaacugauugccaaccaauucaacuccgcuaucgggaagauucaggacucucuaagcuccacagccucagcacugggaaaacuccaggacgucguuaaucagaacgcgcaagcccugaauacucuugugaagcaguugagcaguaacuuuggcgcuaucucuuccguacugaaugauauauuaagccgacucgacaagguggaggccgaaguccagaucgauagacugauuaccgguaggcuucaaucgcugcagacguacgugacacagcaguugauccgcgcagcugagauucgggccucagcaaaccucgccgcuaccaaaaugucugagugcguucuggggcaaaguaagagaguggacuucuguggaaaaggcuaccaccuaauguccuuuccccagagcgcgccacauggugucguguuccugcacguuacuuaugugccggcccaggaaaagaauuuuaccacagcgccugcuaucugccacgauggcaaagcccauuuccccagggagggggucuuuguaucuaacggaacucacugguucgugacccagcgcaauuuuuacgaaccacaaauaauuacaacggacaacaccuucguuagcggcaauugugauguggucaucgggaucgugaacaauacuguauaugacccccuccagccugagcuggauuccuucaaggaggaacuugacaaauacuuuaagaaccauacaucaccagauguggacuugggagauauuaguggcaucaaugccagcgucguuaacauucagaaggagauagaccgacugaaugaaguggcuaaaaacuuaaacgagucucucaucgaccugcaggaacuugguaaguaugagcaauacauuaaauggcccugguauaucuggcugggguucauugcaggacuaaucgccauagugauggucaccaucaugcucugcuguaugacuuccugcuguucaugccugaagggcuguugcaguugugguagcugcugcaaauuugaugaggacgauuccgaaccuguguugaagggcguuaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12501 - RNA, 4094 nt, Artificial Sequence
  SARS-CoV-2/France/HF1805/2020__EPI_ISL_414628 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgcagcccgugauuugauuugcgcucagaaguucaacggccugaccguccugcccccacucuuaacagacgaaaugaucgcccaguauacgucagcacugcuugcugguaccauuacgaguggguggacauuuggcgccggagcggccuugcagaucccuuucgcuaugcaaauggcauaccgguuuaauggcauaggggugacccagaacgugcucuaugagaaucagaaacugauugccaaccaguucaacuccgcuaucggaaagauucaagauucucuaagcuccacagccucagcacugggcaaacuccaggacgucguuaaucagaacgcgcaggcccugaauacucuugugaagcaauugagcaguaacuuuggugcuaucucuuccguacugaaugacauauuaagccgacucgauaagguggaagccgagguccagaucgacagacugauuaccgggaggcuucagucgcugcaaacguacgugacacagcaguugauccgcgcagcugagauucgggccucagcaaaccucgccgcuaccaaaaugucugaaugcguucugggacagaguaagagaguggauuucuguggcaaagguuaccaccuaauguccuuuccccaaagcgcgccacauggcgucguguuccugcacguuacuuaugugccggcccaggagaagaauuuuaccacagcuccugcaaucugccacgacgggaaagcccauuuccccagggaaggagucuuuguaucuaacggcacucacugguucgugacccagcgcaauuuuuacgagccacagauaauuacaacggauaacaccuucguuagcgggaauugugacguggucaucggagugguaaacaauacuguguaugauccccuccaaccugagcuggacuccuucaaggaagaacuugauaaauacuuuaagaaccauacaucaccagacgucgauuugggcgacaucagugguauuaaugccagcguugugaacauccagaaggaaauugaucgacugaaugagguggcuaaaaacuuaaacgaaucucucauagaccugcaggagcuugggaaguaugagcaguacaucaaauggcccugguauauuuggcugggauucaucgcaggccuaauugccaucgucauggugaccauaaugcucugcuguaugacuuccugcuguucaugccugaaggguuguugcaguuguggcagcugcugcaaauuugacgaagaugacuccgagccuguuuugaaggggguaaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12502 - RNA, 4094 nt, Artificial Sequence
  SARS-CoV-2/Netherlands/ZuidHolland_9/2020__EPI_ISL_414445 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgcagcccgugauuugauuugcguccagaaguucaacggccugaccgugcugcccccacucuuaacagacgaaaugaucgcucaguauacgucagcccugcuugcagguaccauuacgaguggguggacauuuggcgcuggagccgcguugcagaucccuuucgccaugcaaauggcuuaccgguuuaauggcauaggggugacccagaacguccucuaugagaaucagaaacugauugcaaaccaguucaacuccgccaucggaaagauucaagauucucuaagcuccacagcuucagcccugggcaaacuccaggacguugugaaucagaacgcacaggcgcugaauacucuuguaaagcaauugagcaguaacuuuggugccaucucuuccgugcugaaugacauauuaagccgacucgauaaggucgaagcugaggugcagaucgacagacugauuaccgggaggcuucagucgcugcaaacguacguuacacagcaguugauccgcgccgcagagauucgggcuucagccaaccucgcagccaccaaaaugucugaaugcgugcugggacagaguaagagagucgauuucuguggcaaagguuaccaccuaauguccuuuccccaaagcgcuccacauggcgugguuuuccugcacgugacuuaugucccggcgcaggagaagaauuuuaccacagccccugcaaucugccacgacgggaaagcucauuuccccagggaaggaguauuugugucuaacggcacucacugguucguuacccagcgcaauuuuuacgagccacagauaauuacaacggauaacaccuucgugagcgggaauugugacgucgugaucggaaucguaaacaauacuguguaugauccccuccaaccugagcuggacuccuucaaggaagaacuugauaaauacuuuaagaaccauacaucaccagacgucgauuugggcgacauuagugguaucaaugccagcguugugaacauucagaaggaaauagaucgacugaaugagguggccaaaaacuuaaacgaaucucucaucgaccugcaggagcuugggaaguaugagcaguacauuaaauggcccugguauaucuggcugggauucauugcuggccuaaucgcaauagucauggugaccaucaugcucugcuguaugacuuccugcuguucaugccugaaggguuguugcaguuguggcagcugcugcaaauuugacgaagaugacuccgagccuguuuugaaggggguaaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12503 - RNA, 4094 nt, Artificial Sequence
  SARS-CoV-2/Finland/FIN03032020A/2020__EPI_ISL_413602 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacaccaauucuuucacgaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauuagcuggaacucaaauaaccuggacaguaaagugggcgggaauuauaacuaccucuaucgucuguuccgcaaguccaaucuuaagccuuuugagagagauauaagcaccgaaaucuaccaggccggaucuacacccuguaacgguguugagggcuucaauugcuacuuuccacugcagucauauggguuccaaccuaccaacggagugggcuaccagcccuauaggguagucguguugaguuuugaacuccugcacgcgccagccacuguuugcggucccaaaaagagcacgaauuuagugaaaaacaagugugucaauuucaacuuuaaugggcugacaggcaccggagugcuaacugaguccaacaaaaaguuccucccuuuccagcaguuuggccgggacauugcagauaccacagacgcuguacgagauccacaaacccuggagauccuugacauaacuccgugcucuuucgggggagugucgguuauuacacccgguacgaauaccagcaaccaggucgccguguuguaccagggcgugaauuguacugaagucccuguugcuauccacgccgaccagcugacaccaaccuggcgcguguauuccacagggucaaacguguuucaaacuagagcaggaugccucaucggcgccgagcauguaaacaauaguuacgaaugugauauucccaucggugcugggauuugcgcgucuuaucagacccagacgaacagcccuaggcgggcacgcuccgucgccucacagagcauaaucgcuuacaccaugucucugggcgccgaaaauuccguggcauacaguaacaauagcauugccaucccaacaaacuucacuaucucuguuaccacagaaauucuucccguguccaugacuaagaccucagucgacuguacgauguauauaugcggagauaguacagaguguagcaaucuguugcuccaauacggcucguuuugcacccagcugaacagagcuuuaacugggaucgccguggagcaggacaaaaauacacaggaaguuuucgcacaagugaagcagauuuauaaaaccccgccuaucaaggauuuuggagguuucaacuuuucccagauucugccagaccccucuaaaccuagcaagaggucauucaucgaggaucuacucuuuaauaagguaacucuggcggacgcuggcuucauaaaacaauacggggauugucuuggagacaucgccgcacgugauuugauuugcgcccagaaguucaacggccugaccguccugcccccacucuuaacagacgaaaugaucgcucaguauacgagugcccugcuugcagguaccauuacuuccggguggacauuuggcgcuggagccgcguugcagaucccuuucgccaugcaaauggcuuaccgguuuaauggcauaggggugacccagaacgugcucuaugagaaucagaaacugauugcaaaccaguucaacucugccaucggaaagauucaagauagccuauccucaacagcuagcgcccugggcaaacuccaggacgucguuaaucagaacgcacaggcgcugaauacucuugugaagcaauugaguucuaacuuuggugccaucuccagcguacugaaugacauauuaucgcgacucgauaagguggaagcugagguccagaucgacagacugauuaccgggaggcuucagucacugcaaacguacgugacacagcaguugauccgcgccgcagagauucgggcuucugccaaccucgcagccaccaaaaugagugaaugcguucugggacaguccaagagaguggauuucuguggcaaagguuaccaccuaaugagcuuuccccaaucugcuccacauggcgucguguuccugcacguuacuuaugugccggcgcaggagaagaauuuuaccacagccccugcaaucugccacgacgggaaagcucauuuccccagggaaggagucuuuguaagcaacggcacucacugguucgugacccagcgcaauuuuuacgagccacagauaauuacaacggauaacaccuucguuuccgggaauugugacguggucaucggaaucgugaacaauacuguauaugauccccuccaaccugagcuggacucauucaaggaagaacuugauaaauacuuuaagaaccauacaaguccagacguggauuugggcgacauuagcgguaucaaugccucugucguuaacauucagaaggaaauagaucgacugaaugagguggccaaaaacuuaaacgaaucccucaucgaccugcaggagcuugggaaguaugagcaguacauuaaauggcccugguauaucuggcugggauucauugcuggccuaaucgcaauagugauggucaccaucaugcucugcuguaugacuucaugcuguaguugccugaaggguuguugcagcuguggcuccugcugcaaauuugacgaagaugacucugagccuguguugaaggggguuaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12504 - RNA, 4094 nt, Artificial Sequence
  SARS-CoV-2/France/GE1977/2020__EPI_ISL_414632 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgcagcccgugauuugauuugcgcucagaaguucaacggccugaccguccugcccccacucuuaacagacgaaaugaucgcccaguauacgucagcacugcuugcugguaccauuacgaguggguggacauuuggcgccggagcggccuugcagaucccuuucgcuaugcaaauggcauaccgguuuaauggcauaggggugacccagaacgugcucuaugagaaucagaaacugauugccaaccaguucaacuccgcuaucggaaagauucaagauucucuauuuagcacagccuccgcacugggcaaacuccaggacgucguuaaucagaacgcgcaggcccugaauacucuugugaagcaauugucaagcaacuucggugcuaucaguucuguacugaaugacauauuaucccgacucgauaagguggaagccgagguccagaucgacagacugauuaccgggaggcuucagagccugcaaacguacgugacacagcaguugauccgcgcagcugagauucgggccucggcaaaccucgccgcuaccaaaaugucagaaugcguucugggacagucuaagagaguggauuuuuguggcaaagguuaccaccuaaugaguuucccccaauccgcgccacauggcgucguguuucugcacguuacuuaugugccggcccaggagaagaauuucaccacagcuccugcaaucugccacgacgggaaagcccauuuucccagggaaggagucuucguaagcaacggcacucacugguuugugacccagcgcaauuucuacgagccacagauaauuacaacggauaacaccuucguuucugggaauugugacguggucaucggaaucgugaacaauacuguauaugauccccuccaaccugagcuggacagcuuuaaggaagaacuugauaaauacuucaagaaccauacauccccagacguggauuugggcgacauuucagguaucaaugccagugucguuaacauucagaaggaaauagaucgacugaaugagguggcuaaaaacuuaaacgaaagccucaucgaccugcaggagcuugggaaguaugagcaguacauuaaauggcccugguauaucuggcugggauuuauugcaggccuaaucgccauagugauggucaccaucaugcucugcuguaugacuucuugcuguuccugccugaaggguuguugcucauguggcaguugcugcaaauucgacgaagaugacagcgagccuguguugaaggggguuaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12505 - RNA, 4094 nt, Artificial Sequence
  SARS-CoV-2/Finland/FIN-313/2020__EPI_ISL_414641 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguucaaaacucuacucgcccugcaucgcucuuaucuuaccccgggcgacuccucaagcggguggacagcaggagccgcugcauacuauguagguuaccugcagcccagaaccuuuuugcucaaguauaaugaaaacggcacgauuacugaugccguggacugcgcucuggauccuuuaagugagacaaaguguacccugaaaucuuucacugucgaaaaggggaucuaccaaacauccaauuuuagggugcagccaaccgagagcauaguucgguuccccaacauuacgaaucucugcccuuuuggagagguguucaacgccacccgcuucgcgucggucuaugcauggaaucgaaaaagaaucucuaacuguguggccgacuacuccguacuuuacaauucagcuaguuuuagcacauucaagugcuauggcguuuccccaacuaaacugaacgacuuguguuuuaccaauguguacgccgauucuuucgucauuaggggugacgaagugcggcagaucgcacccgggcagacaggaaagaucgcugauuauaacuacaaacuaccggacgauuuuacuggcugcgucauugccuggaauagcaacaaccuggacucaaaggugggcgggaauuauaacuaccucuaucgucuguuccgcaagaguaaucuuaaaccuuuugagagagauauauccaccgaaaucuaccaagcgggaagcacacccuguaacgguguugagggcuucaauugcuacuuuccacugcagucuuauggguuccagccuaccaacggagugggcuaccaacccuauaggguagucguguugucauuugaacuccugcacgccccagcaacuguuugcggucccaagaaaaguacgaauuuagugaagaacaaaugugucaauuucaacuuuaaugggcugacaggcaccggagugcuaacugagagcaacaagaaguuccucccuuuccagcaguuuggccgggacauugcugauaccacagacgccguacgagauccacagacccuggagauccuugacauaacuccgugcuccuucgggggagugucuguuauuacacccgguacgaauaccucgaaccaagucgcuguguuguaccagggcgugaauuguacugaagucccuguugccauccacgcagaccagcugacaccaaccuggcgcguguauagcacaggguccaacguguuucagacuagagccggaugccucaucggcgcugagcauguaaacaauucauacgaaugugauauucccaucggugcggggauuugcgcaaguuaucaaacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaaaaccuccgucgacuguacgauguauauaugcggagauucaacagaguguaguaaucuguugcuccaguacggcagcuuuugcacccaacugaacagagccuuaacugggaucgcaguggagcaggacaagaauacacaggaaguuuucgcacaggugaaacaaauuuauaagaccccgccuaucaaagauuuuggagguuucaacuuuucgcagauucugccagaccccuccaagccuucuaagaggagcuucaucgaggaucuacucuuuaauaaaguaacucuggcugacgccggcuucauaaagcaguacggggauugucuuggagacaucgcagcccgugauuugauuugcgcucaaaaauucaacggccugaccguccugcccccacucuuaacagacgaaaugaucgcccaguauacgucagcacugcuugcugguaccauuacgaguggguggacauuuggcgccggagcggccuugcagaucccuuucgcuaugcagauggcauaccgguuuaauggcauaggggugacccaaaacgugcucuaugagaaucagaagcugauugccaaccaguucaacuccgcuaucggaaaaauucaggauucucuaagcuccacagccucagcacugggcaagcuccaagacgucguuaaucagaacgcgcaggcccugaauacucuugugaagcaguugagcaguaacuuuggugcuaucucuuccguacugaaugacauauuaagccgacucgauaaaguggaagccgagguccaaaucgacagacugauuaccgggaggcuucagucgcugcagacguacgugacacaacaguugauccgcgcagcugagauucgggccucagcaaaccucgccgcuaccaagaugucugaaugcguucugggacagaguaaaagaguggauuucuguggcaaggguuaccaccuaauguccuuuccccagagcgcgccacauggcgucguguuccugcacguuacuuaugugccggcccaagagaaaaauuuuaccacagcgccugcuaucugccacgacgggaaggcccauuuccccagggaaggagucuuuguaucuaacggcacucacugguucgugacccagcgcaauuuuuacgagccacagauaauuacaacggauaacaccuucguuagcgggaauugugacguggucaucggaaucgugaacaauacuguauaugauccccuccagccugagcuggacuccuucaaagaagaacuugauaaguacuuuaagaaccauacaucaccagacguggauuugggcgacauuagugguaucaaugccagcgucguuaacauucaaaaagaaauagaucgacugaaugagguggcuaagaacuuaaacgaaucucucaucgaccugcaggagcuugggaaauaugagcaguacauuaaguggcccugguauaucuggcugggauucauugcaggccuaaucgccauagugauggucaccaucaugcucugcuguaugacuuccugcuguucaugccugaaagguuguugcaguuguggcagcugcugcaaguuugacgaagaugacuccgagccuguguugaaggggguuaaacugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12506 - RNA, 4094 nt, Artificial Sequence
  SARS-CoV-2/Netherlands/ZuidHolland_2/2020__EPI_ISL_414556 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcacuggagcaggacaaaaauacacaggaaguguucgcgcaaguuaagcagauuuauaaaaccccgccuaucaaggauuuuggagguuucaacuuuucgcagauucuaccagaccccuccaaaccuucuaagaggagcuucaucgaggaucuccuguuuaauaaggugacucuugcugacgccggcuucauaaaacaauacggggauuguuugggagacaucgcagcccgugaucugauuugcgcucagaaguucaacggccucaccguacugcccccauuacugacagacgaaaugaucgcccaguauacgucagcacuuuuggcugguaccauuacgaguggguggacauuuggcgccggagcggcccuccagaucccuuucgcuaugcaaauggcauaccgguuuaauggcauaggggucacccagaacgugcuguaugagaaucagaaacuaauugccaaccaguucaacuccgcuaucggaaagauucaagauucucugagcuccacagccucagcacucggcaaacugcaggacguggucaaucagaacgcgcaggcccuuaauacuuugguuaagcaacugagcaguaacuuuggugcuaucucuuccguguuaaaugacauacucagccgacuggauaagguagaagccgaggugcagaucgacagacuuauuaccgggaggcugcagucguugcaaacguacgucacacagcagcucauccgcgcagcugagauucgggccucagcaaaccuggccgcuaccaaaaugucugaaugcgugcuaggacagaguaagagaguugauuucuguggcaaagguuaccaccugauguccuuuccccaaagcgcgccacauggcguggucuuccuccacgugacuuauguuccggcccaggagaagaauuuuaccacagcuccugcaaucugccacgacgggaaagcccauuuccccagggaaggaguguuugucucuaacggcacucacugguucguaacccagcgcaauuuuuacgagccacagauaauuacaacggauaacaccuucgugagcgggaauugugacguugugaucggaaucgucaacaauacuguguaugauccccugcaaccugagcuugacuccuucaaggaagaguuggauaaauacuuuaagaaccauacaucaccagacguagaucugggcgacauuagugguaucaaugccagcguggucaacauucagaaggaaauagaucgauuaaaugagguugcuaaaaaccucaacgaaucucugaucgaccuucaggagcuggggaaguaugagcaguacauuaaauggcccugguauaucuggcuaggauucauugcaggccucaucgccauagugauggugaccaucaugcugugcuguaugacuuccugcuguucaugcuugaaggguuguugcaguuguggcagcugcugcaaauuugacgaagaugacuccgagccuguccugaagggggugaaguuacacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12507 - RNA, 4094 nt, Artificial Sequence
  SARS-CoV-2/USA/WA-UW31/2020__EPI_ISL_414618 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacggugccgagggcuucaauugcuacuuuccacugcagucuuauggguuccaaccuaccaacggaguuggcuaccagcccuauagggugguagucuugucauuugaacuccugcacgcaccagcuacugugugcggucccaaaaagaguacgaauuuaguuaaaaacaagugugugaauuucaacuuuaaugggcugacaggcaccggaguccuaacugagagcaacaaaaaguuccucccuuuccagcaguuuggccgggacauugccgauaccacagacgcugugcgagauccacaaacccuggagauccuugacauaacuccgugcuccuucgggggaguaucugugauuacacccgguacgaauaccucgaaccagguugccgucuuguaccaggacgugaauuguacugaagugccugucgcaauccacgccgaucagcugacaccaaccuggcgcguuuauagcacaggcuccaacguguuucaaacuagagcugggugccucaucggagcggagcaugugaacaauucauacgaaugugacauucccaucggcgcagguauuugcgccaguuaucagacccagacgaacucuccuaggcgggcucgcagcguagccucccagucaauaaucgcauacaccaugagccugggggccgaaaauucugucgcuuacuccaacaauaguauugccaucccaacaaacuucacuaucagcgugaccacagaaauucuucccguuucuaugacuaagaccuccguggauuguacgauguauauaugcggcgacucaacagaguguaguaaucuguugcuccaauacggcagcuuuugcacccagcugaacagagcauuaacuggaaucgcggucgagcaggauaaaaauacacaggaaguguucgcucaaguuaagcagauuuauaaaaccccgccuaucaaggacuuugggggauucaacuuuucgcagauucugccagaucccuccaaaccuucuaagaggagcuucaucgaggaccuacucuuuaauaaggugacucuggccgaugcagguuucauaaaacaauacggcgacugucuuggggauaucgccgcucgugacuugauuugcgcccagaaguucaacggacugaccguacugcccccacucuuaacagaugaaaugaucgcacaguauacgucagcucugcuugccggcaccauuacgagugguuggacauuuggggcgggcgccgcuuugcagaucccuuucgcaaugcaaauggccuaccgguuuaauggaauaggcgucacccagaacgugcucuaugagaaucagaaacugauugcuaaccaguucaacuccgccaucgggaagauucaagacucucuaagcuccacagcaucagcgcugggaaaacuccaggacguggucaaucagaacgcccaggcucugaauacucuuguuaagcaauugagcaguaacuuuggcgccaucucuuccgugcugaaugauauauuaagccgacucgacaagguagaagcagaggugcagaucgauagacugauuaccgguaggcuucagucgcugcaaacguacgucacacagcaguugauccgcgcugccgagauucgggcaucagccaaccucgcugcgaccaaaaugucugaaugcgugcuggggcagaguaagagaguugacuucuguggaaaaggcuaccaccuaauguccuuuccccaaagcgccccacaugguguggucuuccugcacgugacuuauguuccggcacaggagaagaauuuuaccacagcuccugccaucugccacgauggcaaagcccauuuccccagggaagggguguuugucucuaacggaacucacugguucguaacccagcgcaauuuuuacgagccacagauaauuacaacggacaacaccuucgugagcggcaauugugauguugugaucgggaucgucaacaauacuguguaugacccccuccaaccugagcuggauuccuucaaggaggaacuugacaaauacuuuaagaaccauacaucaccagauguagacuugggagauauuaguggcaucaaugcuagcguggucaacauucagaaggaaauagaccgacugaaugagguugccaaaaacuuaaacgaaucucucaucgaccugcaggagcuugguaaguaugagcaguacauuaaauggcccugguauaucuggcugggguucauugcaggacuaaucgcgauagugauggugaccaucaugcucugcuguaugacuuccugcuguucaugccugaagggcuguugcaguugugguagcugcugcaaauuugaugaagacgauuccgagccugucuugaagggcgugaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12508 - RNA, 4094 nt, Artificial Sequence
  SARS-CoV-2/South Korea/SNU01/2020__EPI_ISL_411929 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacaccaauucuuucacgaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuugggcucuugagccuuugguggaucugccaaucggcauuaacaucacacgguuccagacucuacucgcccugcaucgcagcuaucuuaccccgggcgacucuuccucaggguggacagcaggagccgcugcauacuauguagguuaccugcaacccagaaccuuuuugcucaaauauaaugaaaacggcacgauuacugaugccguggacugcgcucuggauccuuuaagcgagacaaaguguacccugaagaguuucacugucgaaaaagggaucuaccagacaucuaauuuuagggugcagccaaccgaguccauaguucgguuccccaacauuacgaaucucugcccuuuuggagagguguucaacgccacccgcuucgcgagcgucuaugcauggaaucgaaagagaaucucgaacuguguggccgacuacucuguacuuuacaauuccgcuucauuuaguacauucaaaugcuauggcguuagcccaacuaagcugaacgacuuguguuuuaccaauguguacgccgauuccuucgucauuaggggugacgaagugcggcagaucgcacccgggcaaacaggaaaaaucgcugauuauaacuacaagcuaccggacgauuuuacuggcugcgucauugccuggaacucuaauaaccuggacagcaaagugggcgggaauuauaacuaccucuaucgucuguuccgcaagucaaaucuuaagccuuuugagagagauauaaguaccgaaaucuaccaggcgggauccacacccuguaacgguguugagggcuucaauugcuacuuuccacugcagagcuauggguuccaaccuaccaacggagugggcuaccagcccuauaggguagucguguugucuuuugaacuccugcacgccccagcaacuguuugcggucccaaaaagucaacgaauuuagugaaaaacaagugugucaauuucaacuuuaaugggcugacaggcaccggagugcuaacugagaguaacaaaaaguuccucccuuuccagcaguuuggccgggacauugcugauaccacagacgccguacgagauccacaaacccuggagauccuugacauaacuccgugcagcuucgggggaguguccguuauuacacccgguacgaauaccucuaaccaggucgcuguguuguaccaggacgugaauuguacugaagucccuguugccauccacgcagaucagcugacaccaaccuggcgcguguauucgacaggcagcaacguguuucaaacuagagccgggugccucaucggagcugagcauguaaacaauuccuacgaaugugacauucccaucggcgcggguauuugcgcaucauaucagacccagacgaacaguccuaggcgggcccgcucugucgcuagccaguccauaaucgccuacaccaugucacugggggcagagaauagcguggccuacucuaacaauuccauugcuaucccaacaaacuucacuaucaguguuaccacagaaauucuucccgugagcaugacuaagaccucugucgauuguacgauguauauaugcggcgacuccacagaguguucaaaucuguugcuccaauacggaaguuuuugcacccagcugaacagagccuuaacuggcaucgcaguggagcaggauaaaaauacacaggaaguuuucgcgcaagugaagcagauuuauaaaaccccgccuaucaaggacuuugggggauucaacuuuagccagauucugccagaucccucgaaaccuuccaagaggucuuucaucgaggaccuacucuuuaauaagguaacucuggcugaugccgguuucauaaaacaauacggcgacugucuuggggauaucgcagcccgugacuugauuugcgcucagaaguucaacggacugaccguccucccuccacuguuaacagaugaaaugaucgcccaguauacgagcgcacugcuugcuggcaccauuacuucagguuggacauuuggggccggcgcggccuugcagaucccuuucgcuaugcaaauggcauaccgguuuaauggaauaggcgugacccagaacgugcucuaugagaaucagaaacugauugccaaccaguucaacagugcuaucgggaagauucaagacucccuaucuagcacagccuccgcacugggaaaacuccaggacgucguuaaucagaacgcgcaggcccugaauacucuugugaagcaauugucaagcaacuuuggcgcuaucaguucuguacugaaugauauauuaucccgacucgacaagguggaagccgagguccagaucgauagacugauuaccgguaggcuucagagccugcaaacguacgugacacagcaguugauccgcgcagcugagauucgggccucggcaaaccucgccgcuaccaaaaugucagaaugcguucuggggcagucuaagagaguggacuucuguggaaaaggcuaccaccuaaugaguuuuccccaauccgcgccacauggugucguguuccugcacguuacuuaugugccggcccaggagaagaauuuuaccacagcacccgcuaucugccacgauggcaaagcccauuuccccagggaaggggucuuuguaagcaacggaacucacugguucgugacccagcgcaauuuuuacgagccacagauaauuacaacggacaacaccuucguuucuggcaauugugauguggucaucgggaucgugaacaauacuguauaugacccccuccaaccugagcuggauagcuucaaggaagaacuugacaaauacuuuaagaaccauacauccccagauguggacuugggagauauuucaggcaucaaugccagugucguuaacauucagaaggaaauagaccgacugaaugagguggcuaaaaacuuaaacgaaagccucaucgaccugcaggagcuugguaaguaugagcaguacauuaaauggcccugguauaucuggcugggguucauugcaggacuaaucgccauagugauggucaccaucaugcucugcuguaugacuucuugcuguuccugccugaagggcuguugcucaugugguaguugcugcaaauuugaugaagacgauagcgagccuguguugaagggcguuaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12509 - RNA, 4094 nt, Artificial Sequence
  SARS-CoV-2/China/WF0004/2020__EPI_ISL_413694 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacgaauagcuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggacugagucugaguuccguguguacagcuccgcgaauaacuguaccuuugaguaugugucacaaccuuuccugauggaccuggaaggcaagcaggguaauuuuaaaaaccucagagaguucgucuuuaagaacauugauggguacuucaaaaucuacaguaagcacacaccaauaaauuuaguuagggaccugccccagggauuuagcgcucuugagccuuugguggaucugccaaucggcauuaacaucacucgguuccagacccuacucgcccugcaucgcucuuaucuuacaccgggcgacuccucaagcggguggaccgcaggagccgcugcauacuauguagguuaccugcaacccagaacguuuuugcucaaauauaaugaaaacggcacuauuacagaugccguggacugcgcucuggauccuuuaagugagaccaaguguacucugaagucuuucacagucgaaaaagggaucuaccagaccuccaauuuuagggugcagccaacggagagcauaguucgguuccccaacauuaccaaucucugcccuuuuggagagguguucaacgccacacgcuucgcgucggucuaugcauggaaucgaaagagaaucucuaacuguguggccgacuacuccguacuuuacaauucagcuaguuuuagcacuuucaaaugcuauggcguuuccccaaccaagcugaacgacuuguguuuuacaaauguguacgccgauucuuucgucauuaggggugacgaagugcggcagaucgcacccgggcaaacuggaaaaaucgcugauuauaacuacaagcuaccggacgauuuuaccggcugcgucauugccuggaauagcaacaaccuggacucaaaagugggcgggaauuauaacuaccucuaucgucuguuccgcaagaguaaucuuaagccuuuugagagagauauauccacagaaaucuaccaggcgggaagcacccccuguaacgguguugagggcuucaauugcuacuuuccacugcagucuuauggguuccaaccuacuaacggagugggcuaccagcccuauaggguagucguguugucauuugaacuccugcacgccccagcaacgguuugcggucccaaaaagaguacaaauuuagugaaaaacaagugugucaauuucaacuuuaaugggcugaccggcacuggagugcuaaccgagagcaacaaaaaguuccucccuuuccagcaguuuggccgggacauugcugauacaaccgacgccguacgagauccacaaacucuggagauccuugacauaacaccgugcuccuucgggggagugucuguuauuacgcccgguaccaauacuucgaaccaggucgcuguguuguaccaggacgugaauuguacagaagucccuguugccauccacgcagaucagcugaccccaacauggcgcguguauagcacuggcuccaacguguuucaaaccagagccgggugccucaucggagcugagcauguaaacaauucauacgaaugugacauucccaucggcgcggguauuugcgcaaguuaucagacgcagaccaacucuccuaggcgggcccgcagcgucgcuucccagucaauaaucgccuacacaaugagccugggggcagaaaauucuguggccuacuccaacaauaguauugcuaucccaacuaacuucaccaucagcguuacaacugaaauucuucccgugucuaugaccaagacguccgucgauuguacaauguauauaugcggcgacucaaccgaguguaguaaucuguugcuccaauacggaucuuuuugcacucagcugaacagagccuuaacaggcaucgcaguggagcaggauaaaaauacccaggaaguuuucgcgcaagugaagcagauuuauaaaacuccgccuaucaaggacuuugggggauucaacuuuucgcagauucugccagaucccuccaaaccuucuaagaggagcuucaucgaggaccuacucuuuaauaagguaacccuggcugaugccgguuucauaaaacaauacggcgacugucuuggggauaucgcagcccgugacuugauuugcgcucagaaguucaacggacugacaguccugcccccacucuuaacggaugaaaugaucgcccaguauaccucagcacugcuugcuggcacuauuacaagugguuggaccuuuggggccggcgcggccuugcagaucccuuucgcuaugcaaauggcauaccgguuuaauggaauaggcgugacacagaacgugcucuaugagaaucagaaacugauugccaaccaguucaacuccgcuaucgggaagauucaagacucucuaagcuccacugccucagcacugggaaaacuccaggacgucguuaaucagaacgcgcaggcccugaauacccuugugaagcaauugagcaguaacuuuggcgcuaucucuuccguacugaaugauauauuaagccgacucgacaagguggaagccgagguccagaucgauagacugauuacggguaggcuucagucgcugcaaacauacgugacccagcaguugauccgcgcagcugagauucgggccucagcaaaccucgccgcuacuaaaaugucugaaugcguucuggggcagaguaagagauucgacuuuuguggaaaaggcuaccaccuaauguccuucccccaaagcgcgccacaugguguggucuuucugcacgugaccuauguuccggcccaggagaagaauuucacaacugcuccugcaaucugccacgauggcaaagcccauuuucccagggaagggguguucgucucuaacggaacccacugguuuguaacacagcgcaauuucuacgagccacagauaauuacgaccgacaacacuuucgugagcggcaauugugauguugugaucgggaucgucaacaauacaguguaugacccccuccaaccugagcuggauuccuuuaaggaagaacuugacaaauacuucaagaaccauaccucaccagauguagacuugggagauauuaguggcaucaaugccagcguggucaacauucagaaggaaauagaccgacugaaugagguugcuaaaaacuuaaacgaaucucucaucgaccugcaggagcuugguaaguaugagcaguacauuaaauggcccugguauaucuggcugggguuuauugcaggacuaaucgccauagugauggugacuaucaugcucugcuguaugacauccugcuguucaugccugaagggcuguugcaguugugguagcugcugcaaauucgaugaagacgauuccgagccugucuugaagggcgugaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12510 - RNA, 4094 nt, Artificial Sequence
  SARS-CoV-2/China/WF0028/2020__EPI_ISL_413791 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacaggaaguuuucgcgcaagugaagcagauuuauaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauacggcgacugucuuggggauaucgcagcccgugacuugauuugcgcucagaaguucaacggacugaccguccugcccccacucuuaacagaugaaaugaucgcccaguauacgucagcacugcuugcuggcaccauuacgagugguuggacauuuggggccggcgcggccuugcagaucccuuucgcuaugcaaauggcauaccgguuuaauggaauaggcgugacccagaacgugcucuaugagaaucagaaacugauugccaaccaguucaacuccgcuaucgggaagauucaagacucucuaagcuccacagccucagcacugggaaaacuccaggacgucguuaaucagaacgcgcaggcccugaauacucuugugaagcaauugagcaguaacuuuggcgcuaucucuuccguacugaaugauauauuaagccgacucgacaagguggaagccgagguccagaucgauagacugauuaccgguaggcuucagucgcugcaaacguacgugacacagcaguugauccgcgcagcugagauucgggccucagcaaaccucgccgcuaccaaaaugucugaaugcguucuggggcagaguaagagaguggacuucuguggaaaaggcuaccaccuaauguccuuuccccaaagcgcgccacauggugucguguuccugcacguuacuuaugugccggcccaggagaagaauuuuaccacagcuccugcaaucugccacgauggcaaagcccauuuccccagggaaggggucuuuguaucuaacggaacucacugguucgugacccagcgcaauuuuuacgagccacagauaauuacaacggacaacaccuucguuagcggcaauugugauguggucaucgggaucgugaacaauacuguauaugacccccuccaaccugagcuggaauccuucaaggaggaacuugauaaauacuuuaagaaccauacaucaccagacguggauuugggagacauuaguggcaucaaugccagcgucguuaacauucagaaggagauagaucgacugaaugaaguggcuaaaaacuuaaacgagucucucaucgaccugcaggagcuugguaaguaugaacaguacauuaaauggcccugguauaucuggcugggguucauugcaggacuaaucgccauagugauggucaccaucaugcucugcuguaugacuuccugcuguucaugccugaagggcuguugcaguugugguagcugcugcaaauuugacgaggaugacuccgaaccuguguugaagggcguuaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12511 - RNA, 4094 nt, Artificial Sequence
  SARS-CoV-2/2019-nCoV/USA-CruiseA-18/2020__MT159716.1 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaacugcguguguacagcuccgcgaauaacuguacuuucgaguaugugucacaaccuuuucugauggaccucgaaggcaagcaggguaauuucaaaaacuuaagagaguuugucuucaagaacauugauggguacuuuaaaaucuacaguaagcacaccccaauaaaucugguuagggaccuuccccagggauucagcgcuuuggagccucugguggaucuaccaaucggcauuaacaucacacgguuucagacucuccuggcccuucaucgcucuuaucugaccccgggcgacuccucaagcggguggacagcaggagccgcugcauacuauguagguuacuugcaacccagaaccuuccuccugaaauauaaugaaaacggcacgauuacugaugccguggacugcgcuuuagauccucugagugagacaaaguguacccucaagucuuuuacugucgaaaaagggaucuaccagacauccaauuucagggugcagccaaccgagagcauaguucgguuucccaacauuacgaaucuuugcccuuucggagagguguuuaacgccacccgcuucgcgucggucuaugcauggaaucgaaagagaaucucuaacuguguggccgacuacuccguacuguacaauucagcuaguuucagcacauuuaaaugcuauggcguuuccccaacuaaguugaacgaccuauguuucaccaauguguacgccgauucuuuugucauuaggggugacgaagugcggcagaucgcacccgggcaaacaggaaaaaucgcugauuauaacuacaagcugccggacgauuucacuggcugcgucauugccuggaauagcaacaaccucgacucaaaagugggcgggaauuauaacuaccuguaucgucuuuuucgcaagaguaaucugaagccuuucgagagagauauauccaccgaaaucuaccaggcgggaagcacacccuguaacgguguugagggcuuuaauugcuacuucccauugcagucuuauggguuucaaccuaccaacggagugggcuaccagcccuauaggguagucgugcucucauucgaacuguuacacgccccagcaacuguuugcggucccaaaaagaguacgaaucuggugaaaaacaagugugucaauuuuaacuucaaugggcuaacaggcaccggagugcucacugagagcaacaaaaaguuucugccuuuccagcaguucggccgggacauugcugauaccacagacgccguacgagauccacaaacccuugagaucuuggacauaacuccgugcuccuuugggggagugucuguuauuacacccgguacgaauaccucgaaccaggucgcugugcuguaccaggacgugaauuguacugaagucccuguugccauccacgcagaucagcucacaccaaccuggcgcguguauagcacaggcuccaacguguuccaaacuagagccgggugccugaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccuuggggcagaaaauucuguggccuacuccaacaauaguauugcuaucccaacaaacuuuacuaucagcguuaccacagaaauucugcccgugucuaugacuaagaccuccgucgauuguacgauguauauaugcggcgacucaacagaguguaguaauuugcuccugcaauacggcagcuucugcacccaguuaaacagagcccugacuggaaucgcaguggagcaggauaaaaauacacaggaaguuuuugcgcaagugaagcagauuuauaaaaccccgccuaucaaggacuucgggggauuuaacuucucgcagauucuaccagaucccuccaaaccuucuaagaggagcuuuaucgaggaccuccuguucaauaagguaacucuugcugaugccgguuuuauaaaacaauacggcgacuguuugggggauaucgcagcccgugaccugauuugcgcucagaaguucaacggacucaccguccugcccccauuacugacagaugaaaugaucgcccaguauacgucagcacuuuuggcuggcaccauuacgagugguuggacauucggggccggcgcggcccuccagaucccuuuugcuaugcaaauggcauaccgguucaauggaauaggcgugacccagaacgugcuguaugagaaucagaaacuaauugccaaccaguuuaacuccgcuaucgggaagauucaagacucucugagcuccacagccucagcacucggaaaacugcaggacgucguuaaucagaacgcgcaggcccuuaauacuuuggugaagcaacugagcaguaacuucggcgcuaucucuuccguauuaaaugauauacucagccgacuggacaagguggaagccgagguccagaucgauagacuuauuaccgguaggcugcagucguugcaaacguacgugacacagcagcucauccgcgcagcugagauucgggccucagcaaaccuggccgcuaccaaaaugucugaaugcguucuagggcagaguaagagaguggacuuuuguggaaaaggcuaccaccugauguccuucccccaaagcgcgccacauggugucguguuucuccacguuacuuaugugccggcccaggagaagaauuucaccacagcuccugcaaucugccacgauggcaaagcccauuuucccagggaaggggucuucguaucuaacggaacucacugguuugugacccagcgcaauuucuacgagccacagauaauuacaacggacaacaccuuuguuagcggcaauugugauguggucaucgggaucgugaacaauacuguauaugacccccugcaaccugagcuugauuccuucaaggaagaguuggacaaauacuucaagaaccauacaucaccagauguggaccugggagauauuaguggcaucaaugccagcgucguuaacauucagaaggaaauagaccgauuaaaugagguggcuaaaaaccucaacgaaucucugaucgaccuucaggagcuggguaaguaugagcaguacauuaaauggcccugguauaucuggcuaggguuuauugcaggacucaucgccauagugauggucaccaucaugcugugcuguaugacuuccugcuguucaugcuugaagggcuguugcaguugugguagcugcugcaaauucgaugaagacgauuccgagccugugcugaagggcguuaaguuacacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12512 - RNA, 4094 nt, Artificial Sequence
  SARS-CoV-2/SARS-CoV-2/Yunnan-01/human/2020/CHN__MT049951.1 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccaauacgaacucuuucaccaggggcguauacuauccggacaagguguuucggucaaguguccugcacagcacacaggaucuauuccuccccuuuuucuccaaugugacuugguuucaugcuauccacguuucugggaccaacggaacaaaacgcuucgacaauccugugcugccauuuaacgauggugucuacuucgcaucgaccgagaagucaaauauuauacgaggcuggaucuuugggacuacacuugacagcaaaacccagagucuguugauugugaacaaugccacgaacguaguuaucaaggugugugaguuccaguuuugcaaugaucccuuccucggagucuauuaccauaaaaacaauaaguccuggauggagucugaguuccguguguauagcuccgcgaacaauuguacuuuugaauacgugucacaaccuuuccugauggaccuggaaggcaagcaggguaacuuuaaaaaccucagagaguucgucuuuaagaauauugauggguauuucaaaaucuacaguaagcacaccccaauaaacuuaguuagggaccugccccagggauuuagcgcucuugagccuuugguggaucugccaaucggcauuaauaucacacgguuccagacucuacucgcccugcaucgcucuuaccuuaccccgggcgacuccucaagcggguggacagcaggagccgcugcauauuacguagguuaucugcaacccagaaccuuuuugcucaaauacaacgaaaauggcacgauuacugaugccguggacugcgcucuggauccuuuaagugagacaaaguguacccugaagucuuucacugucgaaaaagggaucuaucagacauccaacuuuagggugcagccaaccgagagcauaguucgguuccccaauauuacgaaccucugcccuuuuggagagguguucaaugccacccgcuucgcgucggucuacgcauggaaccgaaagagaaucucuaauuguguggccgacuauuccguacuuuacaacucagcuaguuuuagcacauucaaaugcuacggcguuuccccaacuaagcugaaugacuuguguuuuaccaacguguaugccgauucuuucgucauuaggggugacgaagugcggcagaucgcacccgggcaaacaggaaaaaucgcugauuacaauuauaagcuaccggacgauuuuacuggcugcgucauugccuggaacagcaacaaucuggacucaaaagugggcgggaacuacaauuaucucuaccgucuguuccgcaagaguaaccuuaagccuuuugagagagauauauccaccgaaaucuaucaggcgggaagcacacccuguaaugguguugagggcuucaacugcuacuuuccacugcagucuuacggguuccaaccuaccaauggagugggcuaucagcccuacaggguagucguguugucauuugaacuccugcacgccccagcaacuguuugcggucccaaaaagaguacgaacuuagugaaaaauaagugugucaacuucaauuuuaacgggcugacaggcaccggagugcuaacugagagcaauaaaaaguuccucccuuuccagcaguuuggccgggacauugcugauaccacagacgccguacgagauccacaaacccuggagauccuugacauaacuccgugcuccuucgggggagugucuguuauuacacccgguacgaacaccucgaaucaggucgcuguguuguaucaggacgugaacuguacugaagucccuguugccauccacgcagaucagcugacaccaaccuggcgcguguacagcacaggcuccaacguguuucaaacuagagccgggugccucaucggagcugagcauguaaauaacucauaugaaugugacauucccaucggcgcggguauuugcgcaaguuaccagacccagacuaauucuccuaggcgggcccgcagcgucgcuucccagucaauaaucgccuauaccaugagccugggggcagagaacucuguggccuacuccaauaacaguauugcuaucccaacaaauuucacuaucagcguuaccacagaaauucuucccgugucuaugacuaagaccuccgucgauuguacgauguacauaugcggcgacucaacagaguguaguaaccuguugcuccaauauggcagcuuuugcacccagcugaauagagccuuaacuggaaucgcaguggagcaggauaaaaacacacaggaaguuuucgcgcaagugaagcagauuuacaaaaccccgccuaucaaggacuuugggggauucaauuuuucgcagauucugccagaucccuccaaaccuucuaagaggagcuucaucgaggaccuacucuuuaacaagguaacucuggcugaugccgguuucauaaaacaauauggcgacugucuuggggauaucgcagcccgugacuugauuugcgcucagaaguucaauggacugaccguccugcccccacucuuaacagaugaaaugaucgcccaguacacgucagcacugcuugcuggcaccauuacgagugguuggacauuuggggccggcgcggccuugcagaucccuuucgcuaugcaaauggcauaucgguuuaacggaauaggcgugacccagaaugugcucuacgagaaccagaaacugauugccaaccaguucaauuccgcuaucgggaagauucaagacucucuaagcuccacagccucagcacugggaaaacuccaggacgucguuaaccagaaugcgcaggcccugaacacucuugugaagcaauugagcaguaauuuuggcgcuaucucuuccguacugaacgauauauuaagccgacucgacaagguggaagccgagguccagaucgauagacugauuaccgguaggcuucagucgcugcaaacguaugugacacagcaguugauccgcgcagcugagauucgggccucagcaaaucucgccgcuaccaaaaugucugaaugcguucuggggcagaguaagagaguggacuucuguggaaaaggcuaccaccuaauguccuuuccccaaagcgcgccacauggugucguguuccugcacguuacuuacgugccggcccaggagaagaacuuuaccacagcuccugcaaucugccacgauggcaaagcccauuuccccagggaaggggucuuuguaucuaauggaacucacugguucgugacccagcgcaacuuuuaugagccacagauaauuacaacggacaauaccuucguuagcggcaacugugauguggucaucgggaucgugaauaacacuguauacgacccccuccaaccugagcuggauuccuucaaggaagaacuugacaaauauuuuaagaaucauacaucaccagauguggacuugggagauauuaguggcaucaacgccagcgucguuaauauucagaaggaaauagaccgacugaacgagguggcuaaaaacuuaaaugaaucucucaucgaccugcaggagcuugguaaguacgagcaguauauuaaauggcccugguacaucuggcugggguucauugcaggacuaaucgccauagugauggucaccaucaugcucugcuguaugacuuccugcuguucaugccugaagggcuguugcaguugugguagcugcugcaaauuugaugaagacgauuccgagccuguguugaagggcguuaagcugcacuauacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12513 - RNA, 4094 nt, Artificial Sequence
  SARS-CoV-2/USA/WA-UW292/2020__EPI_ISL_418077 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacaccaauucuuucacgaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgagcucuacacccuguaacggaguugaggguuucaauugcuacuuuccacugcagucauauggcuuccaaccuaccaacggggugggauaccagcccuauaggguagucguguugaguuuugaacuccugcacgccccagcaacuguuugcggccccaaaaagagcacgaauuuagugaaaaacaagugugucaauuucaacuuuaauggucugacagggaccggcgugcuaacugaguccaacaaaaaguuccucccuuuccagcaguuuggacgggacauugcugauaccacagacgccguacgagauccacaaacccuggagauccuugacauaacuccgugcucuuucggcggggugucgguuauuacacccggaacgaauaccagcaaccaggucgcuguguuguaccaggacgugaauuguacugaagucccuguugccauccacgcagaucagcugacaccaaccuggcgcguguauuccacagguucaaacguguuucaaacuagagccggcugccucaucggggcugagcauguaaacaauaguuacgaaugugacauucccaucggagcgggcauuugcgcaucuuaucagacccagacgaacagcccuaggcgggcccgcuccgucgcuucacagagcauaaucgccuacaccaugucucugggugcagaaaauuccguggccuacaguaacaauagcauugcuaucccaacaaacuucacuaucucuguuaccacagaaauucuucccguguccaugacuaagaccucagucgauuguacgauguauauaugcggggacaguacagaguguagcaaucuguugcuccaauacggcucguuuugcacccagcugaacagagccuuaacuggaaucgcaguggagcaggauaaaaauacacaggaaguuuucgcgcaagugaagcagauuuauaaaaccccgccuaucaaggacuuuggcggguucaacuuuucccagauucugccagaucccucuaaaccuagcaagaggucauucaucgaggaccuacucuuuaauaagguaacucuggcugaugccggauucauaaaacaauacggugacugucuuggcgauaucgcagcccgugacuugauuugcgcucagaaguucaacgggcugaccguccucccuccacuguuaacagaugaaaugaucgcccaguauacgagugcacugcuugcuggaaccauuacuuccggcuggacauuuggugccggggcggccuugcagaucccuuucgcuaugcaaauggcauaccgguuuaauggcauaggagugacccagaacgugcucuaugagaaucagaaacugauugccaaccaguucaacucugcuaucggcaagauucaagacagccuauccucaacagccagcgcacuggggaaacuccaggacgucguuaaucagaacgcgcaggcccugaauacucuugugaagcaauugaguucuaacuuuggagcuaucuccagcguacugaaugauauauuaucgcgacucgacaagguggaagccgagguccagaucgauagacugauuaccggcaggcuucagucacugcaaacguacgugacacagcaguugauccgcgcagcugagauucgggccucugcaaaccucgccgcuaccaaaaugagugaaugcguucugggucaguccaagagaguggacuucugugggaaaggauaccaccuaaugagcuuuccccaaucugcgccacauggcgucguguuccugcacguuacuuaugugccggcccaggagaagaauuuuaccacagcacccgcuaucugccacgaugguaaagcccauuuccccagggaaggcgucuuuguaagcaacgggacucacugguucgugacccagcgcaauuuuuacgagccacagauaauuacaacggacaacaccuucguuuccggaaauugugauguggucaucggcaucgugaacaauacuguauaugacccccuccaaccugagcuggauucauucaaggaagaacuugacaaauacuuuaagaaccauacaaguccagauguggacuugggggauauuagcggaaucaaugccucugucguuaacauucagaaggaaauagaccgacugaaugagguggcuaaaaacuuaaacgaaucccucaucgaccugcaggagcuuggcaaguaugagcaguacauuaaauggcccugguauaucuggcuggguuucauugcagggcuaaucgccauagugauggucaccaucaugcucugcuguaugacuucaugcuguaguugccugaagggauguugcagcuguggcuccugcugcaaauuugaugaagacgauucugagccuguguugaaggguguuaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12514 - RNA, 4094 nt, Artificial Sequence
  SARS-CoV-2/Iceland/192/2020__EPI_ISL_417819 spike protein mRNA human (1-1273)
aggagagucccgcagucggcguccagcggcucugcuuguucgugugugugucguugcaggccuuauucaagcuuaccauguucguguuuuucguccugcucccccuuguuagcucccagugcgugaaccugaccacaagaacucaauugccuccagccuacacuaauucuuuuaccaggggcguauauuacccggacaagguguuccggucaagugucuuacacagcacacaggaucuguuucuacccuucuuuuccaacgugacuugguuccaugcuauccacguuucugggaccaauggaacaaaacgcuuugacaacccugugcucccauucaaugauggugucuauuuugcaucgaccgagaagucaaacauuauacgaggcuggaucuucgggacuacacuggacagcaaaacccagagucuucugauugugaauaacgccacgaauguaguuaucaaggugugugaauuucaguucugcaacgaucccuucuugggagucuacuaucauaaaaauaacaaguccuggauggagucugaauuucguguguacagcuccgcgaauaacuguacuuucgaguaugugucacaaccuuuucucauggaccuggaaggcaagcaggguaauuucaaaaaccugagagaguuugucuucaagaacauugauggguacuuuaaaaucuacaguaagcacaccccaauaaaucucguuagggacuuaccccagggauucagcgcucuggagccucuuguggauuugccaaucggcauuaacaucacacgguuucagacucugcuagcccuccaucgcucuuaucugaccccgggcgacuccucaagcggguggacagcaggagccgcugcauacuauguagguuaccuucaacccagaaccuuccuguugaaauauaaugaaaacggcacgauuacugaugccguggacugcgcucucgauccucugagugagacaaaguguaccuuaaagucuuuuacugucgaaaaagggaucuaccagacauccaauuucagggugcagccaaccgagagcauaguucgguuucccaacauuacgaaucugugcccuuucggagagguguucaacgccacccgcuuugcgucggucuaugcauggaaucgaaagagaaucucuaacuguguggccgacuacuccguacucuacaauucagcuaguuucagcacauuuaaaugcuauggcguuuccccaacuaaacuuaacgaccuguguuucaccaauguguacgccgauucuuuugucauuaggggugacgaagugcggcagaucgcacccgggcaaacaggaaagaucgcugauuauaacuacaaguugccggacgauuucacuggcugcgucauugccuggaauagcaacaaccuagacucaaaagugggcgggaauuauaacuaccuguaucgucucuuucgcaagaguaaucugaagccuuucgagagagauauauccaccgaaaucuaccaggcgggaagcacacccuguaacgguguugagggcuuuaauugcuacuucccacuucagucuuauggguuucaaccuaccaacggagugggcuaccagcccuauaggguagucgugcugucauucgaauugcuccacgccccagcaacuguuugcggucccaaaaagaguacgaaucuggugaaaaacaagugugucaauuuuaacuucaauggguuaacaggcaccggagugcugacugagagcaacaaaaaguuccuaccuuuucagcaguucggccgggacauugcugauaccacagacgccguacgagauccacaaacccucgagauccuggacauaacuccgugcuccuuugggggagugucuguuauuacacccgguacgaauaccucgaaccaggucgcugugcuuuaccagggcgugaauuguacugaagucccuguugccauccacgcagaccaguugacaccaaccuggcgcguguauagcacaggguccaacguguuccaaacuagagccggaugccugaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccucggcgcagaaaauucuguggccuacuccaacaauaguauugcuaucccaacaaacuuuacuaucagcguuaccacagaaauucugcccgugucuaugacuaagaccuccgucgacuguacgauguauauaugcggagauucaacagaguguaguaaucuucuguugcaauacggcagcuucugcacccagcucaacagagcccugacugggaucgcaguggagcaggacaaaaauacacaggaaguuuuugcgcaagugaagcagauuuauaaaaccccgccuaucaaggauuucggagguuuuaacuucucgcagauuuuaccagaccccuccaaaccuucuaagaggagcuuuaucgaggaucugcuauucaauaagguaacucucgcugacgccggcuucauaaaacaauacggggauugucugggagacaucgcagcccgugaucuuauuugcgcucagaaguuuaacggcuugaccguccugcccccacuccugacagacgaaaugaucgcccaguauacgucagcauuacuggcugguaccauuacgaguggguggacauucggcgccggagcggcccuucagaucccuuuugcuaugcaaauggcauaccgguucaauggcauaggggugacccagaacguguuguaugagaaucagaaacucauugccaaccaguuuaacuccgcuaucggaaagauucaagauucucugagcuccacagccucagcacuaggcaaacugcaggacgucguuaaucagaacgcgcaggcccucaauacucuggugaagcaacuuagcaguaacuucggugcuaucucuuccguauugaaugacauacugagccgauuagauaagguggaagccgagguccagaucgacagacucauuaccgggaggcugcagucgcuucaaacguacgugacacagcagcugauccgcgcagcugagauucgggccucagcaaacuuggccgcuaccaaaaugucugaaugcguucucggacagaguaagagaguggauuuuuguggcaaagguuaccaccugauguccuucccccaaagcgcgccacauggcgucguguuucuacacguuacuuaugugccggcccaggagaagaauuucaccacagcuccugcaaucugccacgacgggaaagcccauuuucccagggaaggagucuucguaucuaacggcacucacugguuugugacccagcgcaauuucuacgagccacagauaauuacaacggauaacaccuucguuagcgggaauugugacguggucaucggaaucgugaacaauacuguauaugauccccugcaaccugagcucgacuccuuuaaggaggagcuggauaaauacuucaagaaccauacaucaccagacguggaucuuggcgacauuagugguaucaaugccagcgucguuaacauucagaaggaaauagaucgauugaaugagguggcuaaaaaccugaacgaaucuuuaaucgaccuccaggagcuggggaaguaugagcaguacauuaaauggcccugguauaucuggcuuggauuuauugcaggccugaucgccauagugauggucaccaucaugcuaugcuguaugacuuccugcuguucaugccucaaggguuguugcaguuguggcagcugcugcaaauucgacgaagaugacuccgagccugugcugaaggggguuaaguugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12515 - RNA, 4094 nt, Artificial Sequence
  SARS-CoV-2/Belgium/ULG-6939/2020__EPI_ISL_417020 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucugugguuuacuccaacaauaguauugccaucccaacaaacuucacuaucagcgugaccacagaaauucuucccgucucuaugacuaagaccuccguggacuguacgauguauauaugcggagauucaacagaguguaguaaucuguugcuccaauacggcagcuuuugcacccagcugaacagagcuuuaacugggaucgccguugagcaggacaaaaauacacaggaaguguucgcacaaguaaagcagauuuauaaaaccccgccuaucaaggauuuuggagguuucaacuuuucgcagauucugccagaccccuccaaaccuucuaagaggagcuucaucgaggaucuacucuuuaauaaggucacucuggcggacgcuggcuucauaaaacaauacggggauugucuuggagacaucgccgcacgugauuugauuugcgcccagaaguucaacggccugaccgugcugcccccacucuuaacagacgaaaugaucgcucaguauacgucagcccugcuugcagguaccauuacgaguggguggacauuuggcgcuggagccgcguugcagaucccuuucgccaugcaaauggcuuaccgguuuaauggcauaggggugacccagaacguccucuaugagaaucagaaacugauugcaaaccaguucaacuccgccaucggaaagauucaagauucucuaagcuccacagcuucagcccugggcaaacuccaggacguugugaaucagaacgcacaggcgcugaauacucuuguaaagcaauugagcaguaacuuuggugccaucucuuccgugcugaaugacauauuaagccgacucgauaaggucgaagcugaggugcagaucgacagacugauuaccgggaggcuucagucgcugcaaacguacguuacacagcaguugauccgcgccgcagagauucgggcuucagccaaccucgcagccaccaaaaugucugaaugcgugcugggacagaguaagagagucgauuucuguggcaaagguuaccaccuaauguccuuuccccaaagcgcuccacauggcgugguuuuccugcacgugacuuaugucccggcgcaggagaagaauuuuaccacagccccugcaaucugccacgacgggaaagcucauuuccccagggaaggaguauuugugucuaacggcacucacugguucguuacccagcgcaauuuuuacgagccacagauaauuacaacggauaacaccuucgugagcgggaauugugacgucgugaucggaaucguaaacaauacuguguaugauccccuccaaccugagcuggacuccuucaaggaagaacuugauaaauacuuuaagaaccauacaucaccagacgucgauuugggcgacauuagugguaucaaugccagcguugugaacauucagaaggaaauagaucgacugaaugagguggccaaaaacuuaaacgaaucucucaucgaccugcaggagcuugggaaguaugagcaguacauuaaauggcccugguauaucuggcugggauucauugcuggccuaaucgcaauagucauggugaccaucaugcucugcuguaugacuuccugcuguucaugccugaaggguuguugcaguuguggcagcugcugcaaauuugacgaagaugacuccgagccuguuuugaaggggguaaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12516 - RNA, 4094 nt, Artificial Sequence
  SARS-CoV-2/France/HF2496/2020__EPI_ISL_418231 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgucgcacgugauuugauuugcgcccagaaguucaacggccugaccgugcugcccccacucuuaacagacgaaaugaucgcucaguauacgucagcccugcuugcagguaccauuacgaguggguggacauuuggcgcuggagccgcguugcagaucccuuucgccaugcaaauggcuuaccgguuuaauggcauaggggugacccagaacguccucuaugagaaucagaaacugauugcaaaccaguucaacuccgccaucggaaagauucaagauucucuaagcuccacagcuucagcccugggcaaacuccaggacguugugaaucagaacgcacaggcgcugaauacucuuguaaagcaauugagcaguaacuuuggugccaucucuuccgugcugaaugacauauuaagccgacucgauaaggucgaagcugaggugcagaucgacagacugauuaccgggaggcuucagucgcugcaaacguacguuacacagcaguugauccgcgccgcagagauucgggcuucagccaaccucgcagccaccaaaaugucugaaugcgugcugggacagaguaagagagucgauuucuguggcaaagguuaccaccuaauguccuuuccccaaagcgcuccacauggcgugguuuuccugcacgugacuuaugucccggcgcaggagaagaauuuuaccacagccccugcaaucugccacgacgggaaagcucauuuccccagggaaggaguauuugugucuaacggcacucacugguucguuacccagcgcaauuuuuacgagccacagauaauuacaacggauaacaccuucgugagcgggaauugugacgucgugaucggaaucguaaacaauacuguguaugauccccuccaaccugagcuggacuccuucaaggaagaacuugauaaauacuuuaagaaccauacaucaccagacgucgauuugggcgacauuagugguaucaaugccagcguugugaacauucagaaggaaauagaucgacugaaugagguggccaaaaacuuaaacgaaucucucaucgaccugcaggagcuugggaaguaugagcaguacauuaaauggcccugguauaucuggcugggauucauugcuggccuaaucgcaauagucauggugaccaucaugcucugcuguaugacuuccugcuguucaugccugaaggguuguugcaguuguggcagcugcugcaaauuugacgaagaugacuccgagccuguuuugaaggggguaaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12517 - RNA, 4094 nt, Artificial Sequence
  SARS-CoV-2/USA/WA-UW291/2020__EPI_ISL_418076 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgcagcccgugauuugauuugcgcucagaaguucaacggccugaccguccugcccccacucuuaacagacgaaaugaucgcccaguauacgucagcacugcuugcugguaccauuacgaguggguggacauuuggcgccggagcggccuugcagaucccuuucgcuaugcaaauggcauaccgguuuaauggcauaggggugacccagaacgugcucuaugagaaucagaaacugauugccaaccaguucaacuccgcuaucggaaagauucaauacucucuaagcuccacagccucagcacugggcaaacuccaggaugucguuaaucagaacgcgcaggcccugaauacucuugugaagcaauugagcaguaacuuuggugcuaucucuuccguacugaaugacauauuaagccgacucgacaagguggaagccgagguccagaucgauagacugauuaccgggaggcuucagucgcugcaaacguacgugacacagcaguugauccgcgcagcugagauucgggccucagcaaaccucgccgcuaccaaaaugucugaaugcguucugggacagaguaagagaguggacuucuguggcaaagguuaucaccuaauguccuuuccccaaagcgcgccacauggcgucguguuccugcacguuacuuacgugccggcccaggagaagaauuuuaccacagcuccugcaaucugccacgaugggaaagcccauuuccccagggaaggagucuuuguaucuaacggcacucacugguucgugacccagcgcaauuuuuaugagccacagauaauuacaacggacaacaccuucguuagcgggaauugugauguggucaucggaaucgugaacaauacuguauacgacccccuccaaccugagcuggauuccuucaaggaagaacuugacaaauauuuuaagaaccauacaucaccagauguggacuugggcgauauuagugguaucaaugccagcgucguuaacauucagaaggaaauagaccgacugaaugagguggcuaaaaacuuaaacgaaucucucaucgaucugcaggagcuugggaaguacgagcaguauauuaaauggcccugguacaucuggcugggauucauugcaggccuaaucgccauagugauggucaccaucaugcucugcuguaugacuuccugcuguucaugccugaaggguuguugcaguuguggcagcugcugcaaauuugacgaagacgauuccgagccuguguugaaggggguuaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12518 - RNA, 4094 nt, Artificial Sequence
  SARS-CoV-2/Portugal/PT0034/2020__EPI_ISL_418019 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgcagcccgugauuugauuugcgcucagaaguucaacggccugaccguccugcccccacucuuaacagacgaaaugaucgcccaguauacgucagcacugcuugcugguaccauuacgaguggguggacauuuggcgccggagcggccuugcagaucccuuucgcuaugcaaauggcauaccgguuuaauggcauaggggugacccagaacgugcucuaugagaaucagaaacugauugccaaccaguucaacuccgcuaucggaaagauucaagauucucuaagcuccacagccucagcacugggcaaacuccaggacgucguuaaucagaacgcgcaggcccugaauacucuugugaagcaauugagcaguaacuuuggugcuaucucuuccguacugaaugacauauuaagccgacucgauaagguggaagccgagguccagaucgacagacugauuaccgggaggcuucagucgcugcaaacguacgugacacagcaguugauccgcgcagcugagauucgggccucagcaaaccucgccgcuaccaaaaugucugaaugcguucugggacagaguaagagaguggauuucuguggcaaagguuaccaccuaauguccuuuccccaaagcgcgccacauggcgucguguuccugcacguuacuuaugugccggcccaggagaagaauuuuaccacagcuccugcaaucugccacgacgggaaagcccauuuccccagggaaggagucuuuguaucuaacggcacucacugguucgugacccagcgcaauuuuuacgagccacagauaauuacaacggauaacaccuucguuagcgggaauugugacguggucaucggaaucgugaacaauacuguauaugauccccuccaaccugagcuggacuccuucaaggaagaacuugauaaauacuuuaagaaccauacaucaccagacguggauuugggcgacauuagugguaucaaugccagcgucguuaacauucagaaggaaauagaucgacugaaugagguggcuaaaaacuuaaacgaaucucucaucgaccugcaggagcuugggaaguaugagcaguacauuaaauggcccugguauaucuggcugggauucauugcaggccuaaucgccauagugauggucaccaucaugcucugcuguauuacuuccugcuguucaugccugaaggguuguugcaguuguggcagcugcugcaaauuugacgaagaugacuccgagccuguguugaaggggguuaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12519 - RNA, 4094 nt, Artificial Sequence
  SARS-CoV-2/Iceland/202/2020__EPI_ISL_417750 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacaggaaguuuucgcgcaagugaagcagauuuauaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauacggcgacugucuuggggauaucgcagcccgugacuugauuugcgcucagaaguucaacggacugaccguccugcccccacucuuaacagaugaaaugaucgcccaguauacgucagcacugcuugcuggcaccauuacgagugguuggacauuuggggccggcgcggccuugcagaucccuuucgcuaugcaaauggcauaccgguuuaauggaauaggcgugacccagaacgugcucuaugagaaucagaaacugauugccaaccaguucaacuccgcuaucgggaagauucaagacucucuaagcuccacagccucagcacugggaaaacuccaggacgucguuaaucagaacgcgcaggcccugaauacucuugugaagcaauugagcaguaacuuuggcgcuaucucuuccguacugaaugauauauuaagccgacucgacaagguggaagccgagguccagaucgauagacugauuaccgguaggcuucagucgcugcaaacguacgugacacagcaguugauccgcgcagcugagauucgggccucagcaaaccucgccgcuaccaaaaugucugaaugcguucuggggcagaguaagagaguggacuucuguggaaaaggcuaccaccuaauguccuuuccccaaagcgcgccacauggugucguguuccugcacguuacuuaugugccggcccaggagaagaauuuuaccacagcuccugcaaucugccacgauggcaaagcccauuuccccagggaaggggucuuuguaucuaacggaacucacugguucgugacccagcgcaauuuuuacgagccacagauaauuacaacggacaacaccuucguuagcggcaauugugauguggucaucgggaucgugaacaauacuguauaugacccccuccaaccugagcuggauuccuucaaggaggaacuugacaaauacuuuaagaaccauacaucaccagauguggacuugggagauauucccggcaucaaugccagugucguuaacauucagaaggaaauagaccgacugaaugagguggcuaaaaacuuaaacgaaagccucaucgaccugcaggagcuugguaaguaugagcaguacauuaaauggccuugguauaucuggcugggguucauugcaggacuaaucgccauagugauggucaccaucaugcucugcuguaugacuucuugcuguuccugccugaagggcuguugcucaugugguaguugcugcaaauuugaugaagacgauagcgagccgguguugaagggcguuaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12520 - RNA, 4094 nt, Artificial Sequence
  SARS-CoV-2/USA/WA-UW261/2020__EPI_ISL_418046 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacgaauagcuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucacaucggucuaugcguggaaucgaaagagaaucucuaacuguguggcagacuacuccguacuuuacaauucagccaguuuuagcacuuucaaaugcuauggcguuuccccaaccaagcugaacgacuuguguuuuacaaauguguacgcugauucuuucgucauuaggggugacgaagugcggcagaucgcccccgggcaaacuggaaaaaucgcagauuauaacuacaagcuaccggacgauuuuaccggcugcgucauugcuuggaauagcaacaaccuggacucaaaagugggcgggaauuauaacuaccucuaucgucuguuccgcaagaguaaucuuaagccuuuugagagagauauauccacagaaaucuaccaggccggaagcacccccuguaacgguguugagggcuucaauugcuacuuuccacugcagucuuauggguuccaaccuacuaacggagugggcuaccagcccuauaggguagucguguugucauuugaacuccugcacgcgccagccacgguuugcggucccaaaaagaguacaaauuuagugaaaaacaagugugucaauuucaacuuuaaugggcugaccggcacuggagugcuaaccgagagcaacaaaaaguuccucccuuuccagcaguuuggccgggacauugcagauacaaccgacgcuguacgagauccacaaacucuggagauccuugacauaacaccgugcuccuucgggggagugucuguuauuacgcccgguaccaauacuucgaaccaggucgccguguuguaccaggacgugaauuguacagaagucccuguugcuauccacgccgaucagcugaccccaacauggcgcguguauagcacuggcuccaacguguuucaaaccagagcagggugccucaucggagccgagcauguaaacaauucauacgaaugugacauucccaucggcgcugguauuugcgcgaguuaucagacgcagaccaacucuccuaggcgggcacgcagcgucgccucccagucaauaaucgcuuacacaaugagccugggggccgaaaauucuguggcauacuccaacaauaguauugccaucccaacuaacuucaccaucagcguuacaacugaaauucuucccgugucuaugaccaagacguccgucgauuguacaauguauauaugcggcgacucaaccgaguguaguaaucuguugcuccaauacggaucuuuuugcacucagcugaacagagcuuuaacaggcaucgccguggagcaggauaaaaauacccaggaaguuuucgcacaagugaagcagauuuauaaaacuccgccuaucaaggacuuugggggauucaacuuuucgcagauucugccagaucccuccaaaccuucuaagaggagcuucaucgaggaccuacucuuuaauaagguaacccuggcggaugcugguuucauaaaacaauacggcgacugucuuggggauaucgccgcacgugacuugauuugcgcccagaaguucaacggacugacaguccugcccccacucuuaacggaugaaaugaucgcucaguauaccucagcccugcuugcaggcacuauuacaagugguuggaccuuuggggcuggcgccgcguugcagaucccuuucgccaugcaaauggcuuaccgguuuaauggaauaggcgugacacagaacgugcucuaugagaaucagaaacugauugcaaaccaguucaacuccgccaucgggaagauucaagacucucuaagcuccacugcuucagcccugggaaaacuccaggacgucguuaaucagaacgcacaggcgcugaauacccuugugaagcaauugagcaguaacuuuggcgccaucucuuccguacugaaugauauauuaagccgacucgacaagguggaagcugagguccagaucgauagacugauuacggguaggcuucagucgcugcaaacauacgugacccagcaguugauccgcgccgcagagauucgggcuucagccaaccucgcagccacuaaaaugucugaaugcguucuggggcagaguaagagaguggacuucuguggaaaaggcuaccaccuaauguccuuuccccaaagcgcuccacauggugucguguuccugcacguuaccuaugugccggcgcaggagaagaauuuuacaacugccccugcaaucugccacgauggcaaagcucauuuccccagggaaggggucuuuguaucuaacggaacccacugguucgugacacagcgcaauuuuuacgagccacagauaauuacgaccgacaacacuuucguuagcggcaauugugauguggucaucgggaucgugaacaauacaguauaugacccccuccaaccugagcuggauuccuucaaggaagaacuugacaaauacuuuaagaaccauaccucaccagauguggacuugggagauauuaguggcaucaaugccagcgucguuaacauucagaaggaaauagaccgacugaaugagguggccaaaaacuuaaacgaaucucucaucgaccugcaggagcuugguaaguaugagcaguacauuaaauggcccugguauaucuggcugggguucauugcuggacuaaucgcaauagugauggucacuaucaugcucugcuguaugacauccugcuguucaugccugaagggcuguugcaguugugguagcugcugcaaauuugaugaagacgauuccgagccuguguugaagggcguuaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12521 - RNA, 4094 nt, Artificial Sequence
  SARS-CoV-2/Portugal/PT0035/2020__EPI_ISL_418020 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacgaauagcuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggaucuuuuugcacccagcugaacagagccuuaacuggcaucgcaguggagcaggauaaaaauacacaggaaguuuucgcgcaagugaagcagauuuauaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauacggcgacugucuuggggauaucucagcacgugacuugauuugcgcccagaaguucaacggacugaccguccugcccccacucuuaacagaugaaaugaucgcucaguauacgagugcccugcuugcaggcaccauuacuuccgguuggacauuuggggcuggcgccgcguugcagaucccuuucgccaugcaaauggcuuaccgguuuaauggaauaggcgugacccagaacgugcucuaugagaaucagaaacugauugcaaaccaguucaacucugccaucgggaagauucaagacagccuauccucaacagcuagcgcccugggaaaacuccaggacgucguuaaucagaacgcacaggcgcugaauacucuugugaagcaauugaguucuaacuuuggcgccaucuccagcguacugaaugauauauuaucgcgacucgacaagguggaagcugagguccagaucgauagacugauuaccgguaggcuucagucacugcaaacguacgugacacagcaguugauccgcgccgcagagauucgggcuucugccaaccucgcagccaccaaaaugagugaaugcguucuggggcaguccaagagaguggacuucuguggaaaaggcuaccaccuaaugagcuuuccccaaucugcuccacauggugucguguuccugcacguuacuuaugugccggcgcaggagaagaauuuuaccacagccccugcaaucugccacgauggcaaagcucauuuccccagggaaggggucuuuguaagcaacggaacucacugguucgugacccagcgcaauuuuuacgagccacagauaauuacaacggacaacaccuucguuuccggcaauugugauguggucaucgggaucgugaacaauacuguauaugacccccuccaaccugagcuggauucauucaaggaagaacuugacaaauacuuuaagaaccauacaaguccagauguggacuugggagauauuagcggcaucaaugccucugucguuaacauucagaaggaaauagaccgacugaaugagguggccaaaaacuuaaacgaaucccucaucgaccugcaggagcuugguaaguaugagcaguacauuaaauggcccugguauaucuggcugggguucauugcuggacuaaucgcaauagugauggucaccaucaugcucugcuguaugacuucaugcuguaguugccugaagggcuguugcagcugugguuccugcugcaaauuugaugaagacgauucugagccuguguugaagggcguuaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12522 - RNA, 4094 nt, Artificial Sequence
  SARS-CoV-2/USA/NY-NYUMC7/2020__EPI_ISL_418192 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuaccaucacaaaaauaacaaguccuggauggagucugaguuccguguguauagcuccgcgaauaacuguacuuuugaguacgugucacaaccuuuccugauggaccuggaaggcaagcaggguaauuuuaaaaaccucagagaguucgucuuuaagaacauugauggguauuucaaaaucuacaguaagcauaccccaauaaauuuaguuagggaccugccccagggauuuagcgcucuugagccuuugguggaucugccaaucggcauuaacaucacacgguuccagacucuacucgcccugcaccgcucuuaccuuaccccgggcgacuccucaagcggguggacagcaggagccgcugcauauuacguagguuaucugcaacccagaaccuuuuugcucaaauacaaugaaaacggcacgauuacugaugccguggacugcgcucuggauccuuuaagugagacaaaguguacccugaagucuuucacugucgaaaaagggaucuaucagacauccaauuuuagggugcagccaaccgagagcauaguucgguuccccaacauuacgaaucucugcccuuuuggagagguguucaacgccacccgcuucgcgucggucuacgcauggaaucgaaagagaaucucuaacuguguggccgacuauuccguacuuuacaauucagcuaguuuuagcacauucaaaugcuacggcguuuccccaacuaagcugaacgacuuguguuuuaccaauguguaugccgauucuuucgucauuaggggugacgaagugcggcagaucgcacccgggcaaacaggaaaaaucgcugauuacaacuauaagcuaccggacgauuuuacuggcugcgucauugccuggaauagcaacaaccuggacucaaaagugggcgggaauuacaacuaucucuaccgucuguuccgcaagaguaaucuuaagccuuuugagagagauauauccaccgaaaucuaucaggcgggaagcacacccuguaacgguguugagggcuucaauugcuacuuuccacugcagucuuacggguuccaaccuaccaacggagugggcuaucagcccuacaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaucagggcgugaauuguacugaagucccuguugccauccaugcagaccagcugacaccaaccuggcgcguguacagcacaggguccaacguguuucaaacuagagccggaugccucaucggcgcugagcacguaaacaauucauaugaaugugauauucccaucggugcggggauuugcgcaaguuaccagacccagacgaacucuccuaggcgggcccgcagcgucgcuucccagucaauaaucgccuauaccaugagccugggcgcagaaaauucuguggccuacuccaacaauaguauugcuaucccaacaaacuucacuaucagcguuaccacagaaauucuucccgugucuaugacuaagaccuccgucgacuguacgauguacauaugcggagauucaacagaguguaguaaucuguugcuccaauauggcagcuuuugcacccagcugaacagagccuuaacugggaucgcaguggagcaggacaaaaauacacaggaaguuuucgcgcaagugaagcagauuuacaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauauggggauugucuuggagacaucgcagcccgugauuugauuugcgcucagaaguucaacggccugaccguccugcccccacucuuaacagacgaaaugaucgcccaguacacgucagcacugcuugcugguaccauuacgaguggguggacauuuggcgccggagcggccuugcagaucccuuucgcuaugcaaauggcauaucgguuuaauggcauaggggugacccagaacgugcucuacgagaaucagaaacugauugccaaccaguucaacuccgcuaucggaaagauucaagauucucuaagcuccacagccucagcacugggcaaacuccaggacgucguuaaucagaacgcgcaggcccugaauacucuugugaagcaauugagcaguaacuuuggugcuaucucuuccguacugaaugacauauuaagccgacucgauaagguggaagccgagguccagaucgacagacugauuaccgggaggcuucagucgcugcaaacguaugugacacagcaguugauccgcgcagcugagauucgggccucagcaaaccucgccgcuaccaaaaugucugaaugcguucugggacagaguaagagaguggauuucuguggcaaagguuaccaucuaauguccuuuccccaaagcgcgccacacggcgucguguuccugcacguuacuuacgugccggcccaggagaagaauuuuaccacagcuccugcaaucugccaugacgggaaagcccacuuccccagggaaggagucuuuguaucuaacggcacucauugguucgugacccagcgcaauuuuuaugagccacagauaauuacaacggauaacaccuucguuagcgggaauugugacguggucaucggaaucgugaacaauacuguauacgauccccuccaaccugagcuggacuccuucaaggaagaacuugauaaauauuuuaagaaccacacaucaccagacguggauuugggcgacauuagugguaucaaugccagcgucguuaacauucagaaggaaauagaucgacugaaugagguggcuaaaaacuuaaacgaaucucucaucgaccugcaggagcuugggaaguacgagcaguauauuaaauggcccugguacaucuggcugggauucauugcaggccuaaucgccauagugauggucaccaucaugcucugcuguaugacuuccugcuguucaugccugaaggguuguugcaguuguggcagcugcugcaaauuugacgaagaugacuccgagccuguguugaaggggguuaagcugcauuauacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12523 - RNA, 4094 nt, Artificial Sequence
  SARS-CoV-2/Iceland/189/2020__EPI_ISL_417709 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacaccaauucuuucacgaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucaccaaacaauacggggauugucuuggagacauagcagcccgugauuugaucugcgcucagaaguucaacggccugacaguccucccuccacuguuaacggacgaaaugauugcccaguauaccucagcacugcuugcugguacuaucacaaguggguggaccuuuggcgccggagcggccuugcagauuccuuucgcuaugcaaauggcauaccgguuuaauggcaucggggugacacagaacgugcucuaugagaaucagaaacugauagccaaccaguucaacuccgcuauuggaaagauccaagauucucuaagcuccacugccucagcacugggcaaacuccaggacgucguuaaucagaacgcgcaggcccugaauacccuugugaagcaauugagcaguaacuuuggugcuauuucuuccguacugaaugacaucuuaagccgacucgauaagguggaagccgagguccagauagacagacugaucacggggaggcuucagucgcugcaaacauacgugacccagcaguugauucgcgcagcugagauccgggccucagcaaaccucgccgcuacuaaaaugucugaaugcguucugggacagaguaagagaguggauuucuguggcaaagguuaccaccuaauguccuuuccccaaagcgcgccacauggcgucguguuccugcacguuaccuaugugccggcccaggagaagaauuuuacaacugcacccgcuauuugccacgacgggaaagcccauuuccccagggaaggagucuuuguaucuaacggcacccacugguucgugacacagcgcaauuuuuacgagccacagaucauaacgaccgauaacacuuucguuagcgggaauugugacguggucauuggaaucgugaacaauacaguauaugauccccuccaaccugagcuggacuccuucaaggaagaacuugauaaauacuuuaagaaccauaccucaccagacguggauuugggcgacaucagugguauuaaugccagcgucguuaacauccagaaggaaauugaucgacugaaugagguggcuaaaaacuuaaacgaaucucucauagaccugcaggagcuugggaaguaugagcaguacaucaaauggcccugguauauuuggcugggauucaucgcaggccuaauugccaucgugauggucacuauaaugcucugcuguaugacauccugcuguucaugccugaaggguuguugcaguuguggcagcugcugcaaauuugacgaagaugacuccgagccuguguugaaggggguuaagcugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12524 - RNA, 4094 nt, Artificial Sequence
  SARS-CoV-2/Australia/NSW56/2020__EPI_ISL_417408 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacgaauagcuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggaucuuuuugcacccagcugaacagagccuuaacuggcaucgcaguggagcaggauaaaaauacacaggaaguuuucgcgcaagugaagcagauuuauaaaaccccgccuaucaaggacuuugggggauucaacuuuucgcagauucugccagauuccucuaaacccagcaagaggucauucaucgaggaccuacucuuuaauaagguaacucuggcugaugccgguuucauaaaacaauacggcgacugucuuggggauaucgcagcccgugacuugauuugcgcucagaaguucaacggacugaccguccucccuccccuguuaacagaugaaaugaucgcccaguauacgagugcacugcuugcuggcaccauuacuuccgguuggacauuuggggccggcgcggccuugcagaucccauucgcuaugcaaauggcauaccgguuuaauggaauaggcgugacccagaacgugcucuaugagaaucagaaacugauugccaaccaguucaacucugcuaucgggaagauucaagacagccuauccucaacagccagcgcacugggaaaacuccaggacgucguuaaucagaacgcgcaggcccugaauacucuugugaagcaauugaguucuaacuuuggcgcuaucuccagcguacugaaugauauauuaucgcgacucgacaagguggaagccgagguccagaucgauagacugauuaccgguaggcuucagucacugcaaacguacgugacacagcaguugauccgcgcagcugagauucgggccucugcaaaccucgccgcuaccaaaaugagugaaugcguucuggggcaguccaagagaguggacuucuguggaaaaggcuaccaccuaaugagcuuuccucaaucugcgccccauggugucguguuccugcacguuacuuaugugccagcccaggagaagaauuuuaccacagcaccggcuaucugccacgauggcaaagcccauuucccuagggaaggggucuuuguaagcaacggaacucacugguucgugacccagcgcaauuuuuacgagccccagauaauuacaacggacaacaccuucguuuccggcaauugugauguggucaucgggaucgugaacaauacuguauaugacccacuccaacccgagcuggauucauucaaggaagaacuugacaaauacuuuaagaaccauacaaguccugauguggacuugggagauauuagcggcaucaaugccucugucguuaacauucagaaggaaauagaccgacugaaugagguggcuaaaaacuuaaacgaaucccucaucgaccugcaggagcuugguaaguaugagcaguacauuaaauggccaugguauaucuggcugggguucauugcaggacuaaucgccauagugauggucaccaucaugcucugcuguaugacuucaugcuguaguugccugaagggcuguugcagcugugguuccugcugcaaauuugaugaagacgauucugagcccguguugaagggcguuaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12525 - RNA, 4094 nt, Artificial Sequence
  SARS-CoV-2/Iceland/280/2020__EPI_ISL_417608 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucacacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaguacggcagcuuuugcacccaacugaacagagccuuaacugggaucgcaguggagcaggacaaaaauacacaggaaguuuucgcacaggugaagcaaauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaguacggggauugucuuggagacaucgcagcccgugauuugauuugcgcucaaaaguucaacggccugaccguccugcccccacucuuaacagacgaaaugaucgcccaguauacgucagcacugcuugcugguaccauuacgaguggguggacauuuggcgccggagcggccuugcagaucccuuucgcuaugcagauggcauaccgguuuaauggcauaggggugacccaaaacgugcucuaugagaaucagaaacugauugccaaccaguucaacuccgcuaucggaaagauucaggauucucuaagcuccacagccucagcacugggcaaacuccaagacgucguuaaucagaacgcgcaggcccugaauacucuugugaagcaguugagcaguaacuuuggugcuaucucuuccguacugaaugacauauuaagccgacucgauaagguggaagccgagguccaaaucgacagacugauuaccgggaggcuucagucgcugcagacguacgugacacaacaguugauccgcgcagcugagauucgggccucagcaaaccucgccgcuaccaaaaugucugaaugcguucugggacagaguaagagaguggauuucuguggcaaagguuaccaucuaauguccuuuccccagagcgcgccacacggcgucguguuccugcacguuacuuaugugccggcccaagagaagaauuuuaccacagcgccugcuaucugccaugacgggaaagcccacuuccccagggaaggagucuuuguaucuaacggcacucauugguucgugacccagcgcaauuuuuacgagccacagauaauuacaacggauaacaccuucguuagcgggaauugugacguggucaucggaaucgugaacaauacuguauaugauccccuccagccugagcuggacuccuucaaggaagaacuugauaaauacuuuaagaaccacacaucaccagacguggauuugggcgacauuagugguaucaaugccagcgucguuaacauucaaaaggaaauagaucgacugaaugagguggcuaaaaacuuaaacgaaucucucaucgaccugcaggagcuugggaaguaugagcaguacauuaaauggcccugguauaucuggcugggauucauugcaggccuaaucgccauagugauggucaccaucaugcucugcuguaugacuuccugcuguucaugccugaaggguuguugcaguuguggcagcugcugcaaauuugacgaagaugacuccgagccuguguugaaggggguuaagcugcauuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12526 - RNA, 4094 nt, Artificial Sequence
  SARS-CoV-2/Iceland/247/2020__EPI_ISL_417575 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgcagcccgugauuugauuugcgcucagaaguucaacggccugaccguccugcccccacucuuaacagacgaaaugaucgcccaguauacgucagcacugcuugcugguaccauuacgaguggguggacauuuggcgccggagcggccuugcagaucccuuucgcuaugcaaauggcauaccgguuuaauggcauaggggugacccagaacgugcucuaugagaaucagaaacugauugccaaccaguucaacuccgcuaucggaaagauucaagauucucuaagcuccacagccucagcacugggcaaacuccaggacgucguuaaucagaacgcgcaggcccugaauacucuugugaagcaauugagcaguaacuuuggugcuaucucuuccguacugaaugacauauuaagccgacucgauaagguggaagccgagguccagaucgacagacugauuaccgggaggcuucagucgcugcaaacguacgugacacagcaguugauccgcgcagcugagauucgggccucagcaaaccucgccgcuaccaaaaugucugaaugcguucugggacagaguaagagaguggauuucuguggcaaagguuaccaccuaauguccuuuccccaaagcgcgccacauggcgucguguuccugcacguuacuuaugugccggcccaggagaagaauuuuaccacagcuccugcaaucugccacgacgggaaagcccauuuccccagggaaggagucuuuguaucuaacggcacucacugguucgugacccagcgcaauuuuuacgagccacagauaauuacaacggauaacaccuucguuagcgggaauugugacguggucaucggaaucgugaacaauacuguauaugauccccuccaaccugagcuggacuccuucaaggaagaacuugauaaauacuuuaagaaccauacaucaccagacguggauuugggcgacauuagugguaucaaugccagcgucguuaacauucagaaggaaauagaucgacugaaugagguggcuaaaaacuuaaacgaaucucucaucgaccugcaggagcuugggaaguaugagcaguacauuaaauggcccugguauaucuggcugggauucauugcaggccuaaucgccauagugaucgucaccauuaugcucugcuguaugacuuccugcuguucaugccugaaggguuguugcaguuguggcagcugcugcaaauuugacgaagaugacuccgagccuguguugaaggggguuaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12527 - RNA, 4094 nt, Artificial Sequence
  SARS-CoV-2/Iceland/238/2020__EPI_ISL_417566 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgucggcuucauaaaacaauacggggauugucuuggagacaucgccgcacgugauuugauuugcgcccagaaguucaacggccugaccgugcugcccccacucuuaacagacgaaaugaucgcucaguauacgucagcccugcuugcagguaccauuacgaguggguggacauuuggcgcuggagccgcguugcagaucccuuucgccaugcaaauggcuuaccgguuuaauggcauaggggugacccagaacguccucuaugagaaucagaaacugauugcaaaccaguucaacuccgccaucggaaagauucaagauucucuaagcuccacagcuucagcccugggcaaacuccaggacguugugaaucagaacgcacaggcgcugaauacucuuguaaagcaauugagcaguaacuuuggugccaucucuuccgugcugaaugacauauuaagccgacucgauaaggucgaagcugaggugcagaucgacagacugauuaccgggaggcuucagucgcugcaaacguacguuacacagcaguugauccgcgccgcagagauucgggcuucagccaaccucgcagccaccaaaaugucugaaugcgugcugggacagaguaagagagucgauuucuguggcaaagguuaccaccuaauguccuuuccccaaagcgcuccacauggcgugguuuuccugcacgugacuuaugucccggcgcaggagaagaauuuuaccacagccccugcaaucugccacgacgggaaagcucauuuccccagggaaggaguauuugugucuaacggcacucacugguucguuacccagcgcaauuuuuacgagccacagauaauuacaacggauaacaccuucgugagcgggaauugugacgucgugaucggaaucguaaacaauacuguguaugauccccuccaaccugagcuggacuccuucaaggaagaacuugauaaauacuuuaagaaccauacaucaccagacgucgauuugggcgacauuagugguaucaaugccagcguugugaacauucagaaggaaauagaucgacugaaugagguggccaaaaacuuaaacgaaucucucaucgaccugcaggagcuugggaaguaugagcaguacauuaaauggcccugguauaucuggcugggauucauugcuggccuaaucgcaauagucauggugaccaucaugcucugcuguaugacuuccugcuguucaugccugaaggguuguugcaguuguggcagcugcugcaaauuugacgaagaugacuccgagccuguuuugaaggggguaaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12528 - RNA, 4094 nt, Artificial Sequence
  SARS-CoV-2/Greece/16/2020__EPI_ISL_418265 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacguugauggguacuucaaaauuuacaguaagcacaccccaaucaauuuagugagggaccugccccagggauuuagcgcucuugagccuuugguagaucugccaauaggcaucaacauuacacgguuccagacucuacucgcccugcaucgcucuuaucuuaccccgggcgacuccucaagcggguggacagcaggagccgcugcauacuauguggguuaccugcaacccagaaccuuuuugcucaaauauaaugaaaacggcacgaucacugaugccgucgacugcgcucuggauccuuuaagugagacaaaguguacccugaagucuuucacuguggaaaaagggauuuaccagacauccaauuuuaggguucagccaaccgagagcaucgugcgguuccccaacauaacgaaucucugcccuuuuggagaggucuucaacgccacccgcuucgcgucgguguaugcauggaaucgaaagagaauuucuaacuguguagccgacuacuccguucuuuacaauucagcuaguuuuagcacauucaaaugcuauggcguguccccaacuaagcugaacgacuuguguuuuaccaaugucuacgccgauucuuucgugaucaggggugacgaaguccggcagauugcacccgggcaaacaggaaaaaucgcugauuauaacuacaagcuaccggacgauuuuacuggcugcgugaucgccuggaauagcaacaaccuggacucaaaaguuggcgggaauuauaacuaccucuaucgucuguuccgcaagaguaaucuuaagccuuuugagagagauauuuccaccgaaauauaccaggcgggaagcacacccuguaacgguguggagggcuucaauugcuacuuuccacugcagucuuauggguuccaaccuaccaacggaguaggcuaccagcccuauagggucgugguuuugucauuugaacuccugcacgccccagcaacugugugcggucccaaaaagaguacgaauuuagucaaaaacaagugugugaauuucaacuuuaaugggcugacaggcaccggaguacuaacugagagcaacaaaaaguuccucccuuuccagcaguuuggccgggacaucgcugauaccacagacgccgugcgagauccacaaacccuggagauucuugacaucacuccgugcuccuucgggggaguuucugucauaacacccgguacgaauaccucgaaccagguggcuguguuguaccaggacgucaauuguacugaaguuccuguggccauucacgcagaucagcugacaccaaccuggcgcguguauagcacaggcuccaacguauuucaaacuagagccgggugccucaucggagcugagcaugucaacaauucauacgaaugugacauccccauuggcgcggguaucugcgcaaguuaucagacccagacgaacucuccuaggcgggcccgcagcguggcuucccagucaauuauagccuacaccaugagccugggggcagaaaauucuguugccuacuccaacaauaguaucgcuauuccaacaaacuucacuaucagcgugaccacagaaauccuucccgucucuaugacuaagaccuccguggauuguacgauguauauuugcggcgacucaacagaguguaguaaucuguugcuccaauacggcagcuuuugcacccagcugaacagagccuuaacuggaauagcaguugagcaggauaaaaauacacaggaaguguucgcgcaaguaaagcagaucuauaaaaccccgccuauuaaggacuuugggggauucaacuuuucgcagauccugccagaucccuccaaaccuucuaagaggagcuucauugaggaccuacucuuuaauaaggucacucuggcugaugccgguuucaucaaacaauacggcgacugucuuggggauauagcagcccgugacuugaucugcgcucagaaguucaacggacugaccgugcugcccccacucuuaacagaugaaaugauugcccaguauacgucagcacugcuugcuggcaccaucacgagugguuggacauuuggggccggcgcggccuugcagauuccuuucgcuaugcaaauggcauaccgguuuaauggaaucggcgugacccagaacguccucuaugagaaucagaaacugauagccaaccaguucaacuccgcuauugggaagauccaagacucucuaagcuccacagccucagcacugggaaaacuccaggacguugugaaucagaacgcgcaggcccugaauacucuuguaaagcaauugagcaguaacuuuggcgcuauuucuuccgugcugaaugauaucuuaagccgacucgacaaggucgaagccgaggugcagauagauagacugaucaccgguaggcuucagucgcugcaaacguacguuacacagcaguugauucgcgcagcugagauccgggccucagcaaaccucgccgcuaccaaaaugucugaaugcgugcuggggcagaguaagagagucgacuucuguggaaaaggcuaccaccuaauguccuuuccccaaagcgcgccacauggugugguuuuccugcacgugacuuaugucccggcccaggagaagaauuuuaccacagcuccugcaauuugccacgauggcaaagcccauuuccccagggaagggguauuugugucuaacggaacucacugguucguuacccagcgcaauuuuuacgagccacagaucauaacaacggacaacaccuucgugagcggcaauugugaugucgugauugggaucguaaacaauacuguguaugacccccuccaaccugagcuggauuccuucaaggaggaacuugacaaauacuuuaagaaccauacaucaccagaugucgacuugggagauaucaguggcauuaaugccagcguugugaacauccagaaggaaauugaccgacugaaugagguggcuaaaaacuuaaacgaaucucucauagaccugcaggagcuugguaaguaugagcaguacaucaaauggcccugguauauuuggcugggguucaucgcaggacuaauugccaucgucauggugaccauaaugcucugcuguaugacuuccugcuguucaugccugaagggcuguugcaguugugguagcugcugcaaauuugaugaagacgauuccgagccuguuuugaagggcguaaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12529 - RNA, 4094 nt, Artificial Sequence
  SARS-CoV-2/Iceland/319/2020__EPI_ISL_417648 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauugaccuggaaggcaagcaggguaauuuuaaaaaccucagagaguucgucuuuaagaacaucgauggguacuucaaaauauacaguaagcacaccccaaucaauuuaguuagggaccugccccagggauuuagcgcucuugagccuuugguggaucugccaauuggcaucaacauuacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgaucacugaugccguggacugcgcucuggauccuuuaagugagacaaaguguacccugaagucuuucacugucgaaaaagggauauaccagacauccaauuuuagggugcagccaaccgagagcauuguucgguuccccaacaucacgaaucucugcccuuuuggagagguguucaacgccacccgcuucgcgucggucuaugcauggaaucgaaagagaauuucuaacuguguggccgacuacuccguacuuuacaauucagcuaguuuuagcacauucaaaugcuauggcguuuccccaacuaagcugaacgacuuguguuuuaccaauguguacgccgauucuuucgucaucaggggugacgaagugcggcagaucgcacccgggcaaacaggaaaaauugcugauuauaacuacaagcuaccggacgauuuuacuggcugcgucauagccuggaauagcaacaaccuggacucaaaagugggcgggaauuauaacuaccucuaucgucuguuccgcaagaguaaucuuaagccuuuugagagagauaucuccaccgaaauuuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacaucgcugauaccacagacgccguacgagauccacaaacccuggagauacuugacauuacuccgugcuccuucgggggagugucuguuaucacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucauuggcgcugagcauguaaacaauucauacgaaugugauauccccauuggugcggggauaugcgcaaguuaucagacccagacgaacucuccuaggcgggcccgcagcgucgcuucccagucaaucauugccuacaccaugagccugggcgcagaaaauucuguggccuacuccaacaauaguaucgcuaucccaacaaacuucacuauuagcguuaccacagaaauacuucccgugucuaugacuaagaccuccgucgacuguacgauguauaucugcggagauucaacagaguguaguaaucuguugcuccaauacggcagcuuuugcacccagcugaacagagccuuaacugggauugcaguggagcaggacaaaaauacacaggaaguuuucgcgcaagugaagcagaucuauaaaaccccgccuauuaaggauuuuggagguuucaacuuuucgcagauccugccagaccccuccaaaccuucuaagaggagcuucauagaggaucuacucuuuaauaagguaacucuggcugacgccggcuucaucaaacaauacggggauugucuuggagacauugcagcccgugauuugaucugcgcucagaaguucaacggccugaccguccugcccccacucuuaacagacgaaaugauugcccaguauacgucagcacugcuugcugguaccaucacgaguggguggacauuuggcgccggagcggccuugcagauaccuuucgcuaugcaaauggcauaccgguuuaauggcauuggggugacccagaacgugcucuaugagaaucagaaacugaucgccaaccaguucaacuccgcuauuggaaagauccaagauucucuaagcuccacagccucagcacugggcaaacuccaggacgucguuaaucagaacgcgcaggcccugaauacucuugugaagcaauugagcaguaacuuuggugcuauaucuuccguacugaaugacaucuuaagccgacucgauaagguggaagccgagguccagauugacagacugaucaccgggaggcuucagucgcugcaaacguacgugacacagcaguugauucgcgcagcugagauccgggccucagcaaaccucgccgcuaccaaaaugucugaaugcguucugggacagaguaagagaguggauuucuguggcaaagguuaccaccuaauguccuuuccccaaagcgcgccacauggcgucguguuccugcacguuacuuaugugccggcccaggagaagaauuuuaccacagcuccugcaauaugccacgacgggaaagcccauuuccccagggaaggagucuuuguaucuaacggcacucacugguucgugacccagcgcaauuuuuacgagccacagauuaucacaacggauaacaccuucguuagcgggaauugugacguggucaucggaauugugaacaauacuguauaugauccccuccaaccugagcuggacuccuucaaggaagaacuugauaaauacuuuaagaaccauacaucaccagacguggauuugggcgacaucagugguauuaaugccagcgucguuaacauacagaaggaaaucgaucgacugaaugagguggcuaaaaacuuaaacgaaucucucauugaccugcaggagcuugggaaguaugagcaguacaucaaauggcccugguauauuuggcugggauucaucgcaggccuaauagccaucgugauggucaccauuaugcucugcuguaugacuuccugcuguucaugccugaaggguuguugcaguuguggcagcugcugcaaauuugacgaagaugacuccgagccuguguugaaggggguuaagcugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12530 - RNA, 4094 nt, Artificial Sequence
  SARS-CoV-2/Congo/94/2020__EPI_ISL_417947 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggauauacuauuuaauaagguaacucucgcugacgccggcuucaucaaacaauacggggauugucugggagacauugcagcccgugaucuuaucugcgcucagaaguucaacggcuugaccguccugcccccacuccugacagacgaaaugauugcccaguauacgucagcauuacuggcugguaccaucacgaguggguggacauuuggcgccggagcggcccuucagauaccuuucgcuaugcaaauggcauaccgguuuaauggcauuggggugacccagaacguguuguaugagaaucagaaacucaucgccaaccaguucaacuccgcuauuggaaagauccaagauucucugagcuccacagccucagcacuaggcaaacugcaggacgucguuaaucagaacgcgcaggcccucaauacucuggugaagcaacuuagcaguaacuuuggugcuauaucuuccguauugaaugacauccugagccgauuagauaagguggaagccgagguccagauugacagacucaucaccgggaggcugcagucgcuucaaacguacgugacacagcagcugauucgcgcagcugagauccgggccucagcaaacuuggccgcuaccaaaaugucugaaugcguucucggacagaguaagagaguggauuucuguggcaaagguuaccaccugauguccuuuccccaaagcgcgccacauggcgucguguuccuacacguuacuuaugugccggcccaggagaagaauuuuaccacagcuccugcaauaugccacgacgggaaagcccauuuccccagggaaggagucuuuguaucuaacggcacucacugguucgugacccagcgcaauuuuuacgagccacagauuaucacaacggauaacaccuucguuagcgggaauugugacguggucaucggaauugugaacaauacuguauaugauccccugcaaccugagcucgacuccuucaaggaagaacuggauaaauacuuuaagaaccauacaucaccagacguggaucuuggcgacaucagugguauuaaugccagcgucguuaacauacagaaggaaaucgaucgauugaaugagguggcuaaaaaccugaacgaaucuuuaauugaccuccaggagcuggggaaguaugagcaguacaucaaauggcccugguauauuuggcuuggauucaucgcaggccugauagccaucgugauggucaccauuaugcuaugcuguaugacuuccugcuguucaugccucaaggguuguugcaguuguggcagcugcugcaaauuugacgaagaugacuccgagccugugcugaaggggguuaaguugcacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12531 - RNA, 4094 nt, Artificial Sequence
  SARS-CoV-2/Congo/158/2020__EPI_ISL_417950 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacaggaaguuuucgcgcaagugaagcagauuuauaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauacggcgacugucuuggggauaucgcagcccgugacuugauuugcgcucagaaguucaacggacugaccguccugcccccacucuuaacagaugaaaugaucgcccaguauacgucagcacugcuugcuggcaccauuacgagugguuggacauuuggggccggcgcggccuugcagaucccuuucgcuaugcaaauggcauaccgguuuaauggaauaggcgugacccagaacgugcucuaugagaaucagaaacugauugccaaccaguucaacuccgcuaucgggaagauucaagacucucuaagcuccacagccucagcacugggaaaacuccaggacgucguuaaucagaacgcgcaggcccugaauacucuugugaagcaauugagcaguaacuuuggcgcuaucucuuccguacugaaugauauauuaagccgacucgacaagguggaagccgagguccagaucgauagacugauuaccgguaggcuucagucgcugcaaacguacgugacacagcaguugauccgcgcagcugagauucgggccucagcaaaccucgccgcuaccaaaaugucugaaugcguucuggggcagaguaagagaguggacuucuguggaaaaggcuaccaccuaauguccuuuccccaaagcgcgccacauggugucguguuccugcacguuacuuaugugccggcccaggagaagaauuuuaccacagcuccugcaaucugccacgauggcaaagcccauuuccccagggaaggggucuuuguaucuaacggaacucacugguucgugacccagcgcaauuuuuacgagccacagauaauuacaacggacaacaccuuccucagcggcaauugugauguugugaucgggaucgucaacaauacuguguaugacccccugcaaccugagcuugauuccuucaaggaagaguuggacaaauacuuuaagaaccauacaucaccagauguagaccugggagauauuaguggcaucaaugccagcguggucaacauucagaaggaaauagaccgauuaaaugagguugcuaaaaaccucaacgaaucucugaucgaccuucaggagcuggguaaguaugagcaguacauuaaauggcccugguauaucuggcuaggguucauugcaggacucaucgccauagugauggugaccaucaugcugugcuguaugacuuccugcuguucaugcuugaagggcuguugcaguugugguagcugcugcaaauuugaugaagacgauuccgagccuguccugaagggcgugaaguuacacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12532 - RNA, 4094 nt, Artificial Sequence
  SARS-CoV-2/USA/UT-00034/2020__EPI_ISL_417977 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuauuacaaaaauaacaaguccuggauggagucugaguuccguguguauagcuccgcgaauaacuguacuuuugaguacgugucacaaccuuuccugauggaccuggaaggcaagcaggguaauuuuaaaaaccucagagaguucgucuuuaagaacauugauggguacuucaaaaucuauaguaagcauaccccaauaaauuuaguuagggaccugccccagggauuuagcgcucuugagccuuugguggaucugccaaucggcauuaacaucacacgguuccagacucuacucgcccugcaccgcucuuaccuuaccccgggcgacuccucaagcggguggacagcaggagccgcugcauauuacguagguuaucugcaacccagaaccuuuuugcucaaauacaaugaaaacggcacgauuacugaugccguggacugcgcucuggauccuuuaagugagacaaaguguacccugaagucuuucacugucgaaaaagggaucuaucagacauccaauuuuagggugcagccaaccgagagcauaguucgguuccccaacauuacgaaucucugcccuuuuggagagguguucaacgccacccgcuucgcgucggucuacgcauggaaucgaaagagaaucucuaacuguguggccgacuacuccguacuuuauaauucagcuaguuuuagcacauucaaaugcuacggcguuuccccaacuaagcugaacgacuuguguuuuaccaauguguaugccgauucuuucgucauuaggggugacgaagugcggcagaucgcacccgggcaaacaggaaaaaucgcugauuacaacuauaagcuaccggacgauuuuacuggcugcgucauugccuggaauagcaacaaccuggacucaaaagugggcgggaauuacaacuaucucuaccgucuguuccgcaagaguaaucuuaagccuuuugagagagauauauccaccgaaaucuaccaggcgggaagcacacccuguaacgguguugagggcuucaauugcuauuuuccacugcagucuuacggguuccaaccuaccaacggagugggcuaucagcccuacaggguagucguguugucauuugaacuccugcaugccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaucagggcgugaauuguacugaagucccuguugccauccacgcagaccagcugacaccaaccuggcgcguguacagcacaggguccaacguguuucaaacuagagccggaugccucaucggcgcugagcacguaaacaauucauaugaaugugauauucccaucggugcggggauuugcgcaaguuaccagacccagacgaacucuccuaggcgggcccgcagcgucgcuucccagucaauaaucgccuacaccaugagccugggcgcagaaaauucuguggccuauuccaacaauaguauugcuaucccaacaaacuucacuaucagcguuaccacagaaauucuucccgugucuaugacuaagaccuccgucgacuguacgauguacauaugcggagauucaacagaguguaguaaucuguugcuccaauauggcagcuuuugcacccagcugaacagagccuuaacugggaucgcaguggagcaggacaaaaauacacaggaaguuuucgcgcaagugaagcagauuuacaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauauggggauugucuuggagacaucgcagcccgugauuugauuugcgcucagaaguucaacggccugaccguccugcccccacucuuaacagacgaaaugaucgcccaguacacgucagcacugcuugcugguaccauuacgaguggguggacauuuggcgccggagcggccuugcagaucccuuucgcuaugcaaauggcauaucgguuuaauggcauaggggugacccagaacgugcucuacgagaaucagaaacugauugccaaccaguucaacuccgcuaucggaaagauucaagauucucuaagcuccacagccucagcacugggcaaacuccaggacgucguuaaucagaacgcgcaggcccugaauacucuugugaagcaauugagcaguaacuuuggugcuaucucuuccguacugaaugacauauuaagccgacucgauaagguggaagccgagguccagaucgacagacugauuaccgggaggcuucagucgcugcaaacguacgugacacagcaguugauccgcgcagcugagauucgggccucagcaaaccucgccgcuaccaaaaugucugaaugcguucugggacagaguaagagaguggauuucuguggcaaagguuaucaucuaauguccuuuccccaaagcgcgccacacggcgucguguuccugcauguuacuuacgugccggcccaggagaagaauuuuaccacagcuccugcaaucugccacgacgggaaagcccacuuccccagggaaggagucuuuguaucuaacggcacucauugguucgugacccagcgcaauuuuuaugagccacagauaauuacaacggauaacaccuucguuagcgggaauugugacguggucaucggaaucgugaacaauacuguauacgauccccuccaaccugagcuggacuccuucaaggaagaacuugauaaauauuuuaagaaccacacaucaccagacguggauuugggcgacauuagugguaucaaugccagcgucguuaacauucagaaggaaauagaucgacugaaugagguggcuaaaaacuuaaacgaaucucucaucgaccugcaggagcuugggaaguacgagcaguauauuaaauggcccugguacaucuggcugggauucauugcaggccuaaucgccauagugauggucaccaucaugcucugcuguaugacuuccugcuguucaugccugaaggguuguugcaguuguggcagcugcugcaaauuugacgaagaugacuccgagccuguguugaaggggguuaagcugcauuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12533 - RNA, 4094 nt, Artificial Sequence
  SARS-CoV-2/USA/UT-00033/2020__EPI_ISL_417976 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcgggcugacagcaggagccgcugcauacuauguagguuacuugcaacccagaaccuuucuccugaaauauaaugaaaacggcacgauuacugaugccguggacugcgcuuuagauccucugagugagacaaaguguacccucaagucuuucacugucgaaaaagggaucuaccagacauccaauuuuagggugcagccaaccgagagcauaguucgguuccccaacauuacgaaucuuugcccuuuuggagagguguucaacgccacccgcuucgcgucggucuaugcauggaaucgaaagagaaucucuaacuguguggccgacuacuccguacuguacaauucagcuaguuuuagcacauucaaaugcuauggcguuuccccaacuaaguugaacgaccuauguuuuaccaauguguacgccgauucuuucgucauuaggggugacgaagugcggcagaucgcacccgggcaaacaggaaaaaucgcugauuauaacuacaagcugccggacgauuuuacuggcugcgucauugccuggaauagcaacaaccucgacucaaaagugggcgggaauuauaacuaccuguaucgucuuuuccgcaagaguaaucugaagccuuuugagagagauauauccaccgaaaucuaccaggcgggaagcacacccuguaacgguguugagggcuucaauugcuacuuuccauugcagucuuauggguuccaaccuaccaacggagugggcuaccagcccuauaggguagucgugcucucauuugaacuguuacacgccccagcaacuguuugcggucccaaaaagaguacgaaucuggugaaaaacaagugugucaauuucaacuuuaaugggcuaacaggcaccggagugcucacugagagcaacaaaaaguuccugccuuuccagcaguuuggccgggacauugcugauaccacagacgccguacgagauccacaaacccuugagaucuuggacauaacuccgugcuccuucgggggagugucuguuauuacacccgguacgaauaccucgaaccaggucgcugugcuguaccagggcgugaauuguacugaagucccuguugccauccacgcagaccagcucacaccaaccuggcgcguguauagcacaggguccaacguguuucaaacuagagccggaugccugaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccuuggcgcagaaaauucuguggccuacuccaacaauaguauugcuaucccaacaaacuucacuaucagcguuaccacagaaauucugcccgugucuaugacuaagaccuccgucgacuguacgauguauauaugcggagauucaacagaguguaguaauuugcuccugcaauacggcagcuuuugcacccaguuaaacagagcccugacugggaucgcaguggagcaggacaaaaauacacaggaaguuuucgcgcaagugaagcagauuuauaaaaccccgccuaucaaggauuuuggagguuucaacuuuucgcagauucuaccagaccccuccaaaccuucuaagaggagcuucaucgaggaucuccuguuuaauaagguaacucuugcugacgccggcuucauaaaacaauacggggauuguuugggagacaucgcagcccgugaucugauuugcgcucagaaguucaacggccucaccguccugcccccauuacugacagacgaaaugaucgcccaguauacgucagcacuuuuggcugguaccauuacgaguggguggacauuuggcgccggagcggcccuccagaucccuuucgcuaugcaaauggcauaccgguuuaauggcauaggggugacccagaacgugcuguaugagaaucagaaacuaauugccaaccaguucaacuccgcuaucggaaagauucaagauucucugagcuccacagccucagcacucggcaaacugcaggacgucguuaaucagaacgcgcaggcccuuaauacuuuggugaagcaacugagcaguaacuuuggugcuaucucuuccguauuaaaugacauacucagccgacuggauaagguggaagccgagguccagaucgacagacuuauuaccgggaggcugcagucguugcaaacguacgugacacagcagcucauccgcgcagcugagauucgggccucagcaaaccuggccgcuaccaaaaugucugaaugcguucuaggacagaguaagagaguggauuucuguggcaaagguuaccaccugauguccuuuccccaaagcgcgccacauggcgucguguuccuccacguuacuuaugugccggcccaggagaagaauuuuaccacagcuccugcaaucugccacgacgggaaagcccauuuccccagggaaggagucuuuguaucuaacggcacucacugguucgugacccagcgcaauuuuuacgagccacagauaauuacaacggauaacaccuucguuagcgggaauugugacguggucaucggaaucgugaacaauacuguauaugauccccugcaaccugagcuugacuccuucaaggaagaguuggauaaauacuuuaagaaccauacaucaccagacguggaucugggcgacauuagugguaucaaugccagcgucguuaacauucagaaggaaauagaucgauuaaaugagguggcuaaaaaccucaacgaaucucugaucgaccuucaggagcuggggaaguaugagcaguacauuaaauggcccugguauaucuggcuaggauucauugcaggccucaucgccauagugauggucaccaucaugcugugcuguaugacuuccugcuguucaugcuugaaggguuguugcaguuguggcagcugcugcaaauuugacgaagaugacuccgagccugugcugaaggggguuaaguuacacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12534 - RNA, 4094 nt, Artificial Sequence
  SARS-CoV-2/USA/WI-13/2020__EPI_ISL_417516 spike protein mRNA human (1-1273)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcucccaaccgagagcauaguucgguuccccaacauuacgaaucuuugcccuuuuggagagguguucaacgccacccgcuucgcgucggucuaugcauggaaucgaaagagaaucucuaacuguguggccgacuacuccguacuguacaauucagcuaguuuuagcacauucaaaugcuauggcguuuccccaacuaaguugaacgaccuauguuuuaccaauguguacgccgauucuuucgucauuaggggugacgaagugcggcagaucgcacccgggcagacaggaaaaaucgcugauuauaacuacaagcugccggacgauuuuacuggcugcgucauugccuggaauagcaacaaccucgacucaaaagugggcgggaauuauaacuaccuguaucgucuuuuccgcaagaguaaucugaagccuuuugagagagauauauccaccgaaaucuaccaagcgggaagcacacccuguaacgguguugagggcuucaauugcuacuuuccauugcagucuuauggguuccagccuaccaacggagugggcuaccaacccuauaggguagucgugcucucauuugaacuguuacacgccccagcaacuguuugcggucccaaaaagaguacgaaucuggugaaaaacaagugugucaauuucaacuuuaaugggcuaacaggcaccggagugcucacugagagcaacaaaaaguuccugccuuuccagcaguuuggccgggacauugcugauaccacagacgccguacgagauccacagacccuugagaucuuggacauaacuccgugcuccuucgggggagugucuguuauuacacccgguacgaauaccucgaaccaagucgcugugcuguaccagggcgugaauuguacugaagucccuguugccauccacgcagaccagcucacaccaaccuggcgcguguauagcacaggguccaacguguuucagacuagagccggaugccugaucggcgcugagcauguaaacaauucauacgaaugugauauucccaucggugcggggauuugcgcaaguuaucaaacccagacgaacucuccuaggcgggcccgcagcgucgcuucccagucaauaaucgccuacaccaugagccuuggcgcagaaaauucuguggccuacuccaacaauaguauugcuaucccaacaaacuucacuaucagcguuaccacagaaauucugcccgugucuaugacuaagaccuccgucgacuguacgauguauauaugcggagauucaacagaguguaguaauuugcuccugcaguacggcagcuuuugcacccaauuaaacagagcccugacugggaucgcaguggagcaggacaaaaauacacaggaaguuuucgcacaggugaagcaaauuuauaaaaccccgccuaucaaggauuuuggagguuucaacuuuucgcagauucuaccagaccccuccaaaccuucuaagaggagcuucaucgaggaucuccuguuuaauaagguaacucuugcugacgccggcuucauaaaacaguacggggauuguuugggagacaucgcagcccgugaucugauuugcgcucaaaaguucaacggccucaccguccugcccccauuacugacagacgaaaugaucgcccaguauacgucagcacuuuuggcugguaccauuacgaguggguggacauuuggcgccggagcggcccuccagaucccuuucgcuaugcagauggcauaccgguuuaauggcauaggggugacccaaaacgugcuguaugagaaucagaaacuaauugccaaccaguucaacuccgcuaucggaaagauucaggauucucugagcuccacagccucagcacucggcaaacugcaagacgucguuaaucagaacgcgcaggcccuuaauacuuuggugaagcagcugagcaguaacuuuggugcuaucucuuccguauuaaaugacauacucagccgacuggauaagguggaagccgagguccaaaucgacagacuuauuaccgggaggcugcagucguugcagacguacgugacacaacagcucauccgcgcagcugagauucgggccucagcaaaccuggccgcuaccaaaaugucugaaugcguucuaggacagaguaagagaguggauuucuguggcaaagguuaccaccugauguccuuuccccagagcgcgccacauggcgucguguuccuccacguuacuuaugugccggcccaagagaagaauuuuaccacagcgccugcuaucugccacgacgggaaagcccauuuccccagggaaggagucuuuguaucuaacggcacucacugguucgugacccagcgcaauuuuuacgagccacagauaauuacaacggauaacaccuucguuagcgggaauugugacguggucaucggaaucgugaacaauacuguauaugauccccugcagccugagcuugacuccuucaaggaagaguuggauaaauacuuuaagaaccauacaucaccagacguggaucugggcgacauuagugguaucaaugccagcgucguuaacauucaaaaggaaauagaucgauuaaaugagguggcuaaaaaccucaacgaaucucugaucgaccuucaggagcuggggaaguaugagcaguacauuaaauggcccugguauaucuggcuaggauucauugcaggccucaucgccauagugauggucaccaucaugcugugcuguaugacuuccugcuguucaugcuugaaggguuguugcaguuguggcagcugcugcaaauuugacgaagaugacuccgagccugugcugaaggggguuaaguuacacuacacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12535 - RNA, 4091 nt, Artificial Sequence
  SARS-CoV-2/India/1-27/2020__EPI_ISL_413522 spike protein mRNA human (1-1272)
aggagagucccgcagucggcguccagcggcucugcuuguucgugugugugucguugcaggccuuauucaagcuuaccauguucguguuucugguccuccuuccccugguuagcucccagugcgugaacuugaccacaagaacucaauuaccuccagccuacacgaauagcuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuaccauaaaaauaacaaguccuggauggagucugaguuccguguguauagcuccgcgaauaacuguacuuuugaauacgugucacaaccuuuccugauggaccuggaaggcaagcaggguaauuuuaaaaaccucagagaguucgucuuuaagaacauugauggguauuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaccuuaccccgggcgacuccucaagcggguggacagcaggagccgcugcauauuacguagguuaucugcaacccagaaccuuuuugcucaaauacaaugaaaacggcacgauuacugaugccguggacugcgcucuggauccuuuaagugagacaaaguguacccugaagucuuucacugucgaaaaagggaucuaucagacauccaauuuuagggugcagccaaccgagagcauaguucgguuccccaacauuacgaaucucugcccuuuuggagagguguucaacgccacccgcuucgcgucggucuacgcauggaaucgaaagagaaucucuaacuguguggccgacuauuccguacuuuacaauucagcuaguuuuagcacauucaaaugcuacggcguuuccccaacuaagcugaacgacuuguguuuuaccaauguguaugccgauucuuucgucauuaggggugacgaagugauccagaucgcacccgggcaaacaggaaaaauugcugauuacaacuauaagcuaccggacgauuuuacuggcugcgucauagccuggaauagcaacaaccuggacucaaaagugggcgggaauuacaacuaucucuaccggcuguuccguaagaguaaucuuaagccuuuugagcgcgauaucuccaccgaaauuuaucaggcgggaagcacacccuguaacgguguugagggcuucaauugcuacuuuccacugcagucuuacggguuccaaccuaccaacggagugggcuaucagcccuacagaguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggcagggacaucgcugauaccacagacgccguacgggauccacaaacccuggagauacuugacauuacuccgugcuccuucgggggagugucuguuaucacacccgguacgaauaccucgaaccaggucgcuguguuguaucaggacgugaauuguacugaagucccuguugccauccacgcagaucagcugacaccaaccuggcgaguguacagcacaggcuccaacguguuucaaacucgcgccgggugccucauuggagcugagcauguaaacaauucauaugaaugugacauccccauuggcgcggguauaugcgcaaguuaccagacccagacgaacucuccuagaagggcccggagcgucgcuucccagucaaucauugccuauaccaugagccugggggcagaaaauucuguggccuacuccaacaauaguaucgcuaucccaacaaacuucacuauuagcguuaccacagaaauacuucccgugucuaugacuaagaccuccgucgauuguacgauguacaucugcggcgacucaacagaguguaguaaucuguugcuccaauauggaucuuuuugcacccagcugaaccgcgccuuaacuggcauugcaguggagcaggauaaaaauacacaggaaguuuucgcgcaagugaagcagaucuacaaaaccccgccuauuaaggacuuugggggauucaacuuuucgcagauccugccagaucccuccaaaccuucuaagagaaguuucauagaggaccuacucuuuaauaagguaacucuggcugaugccgguuucaucaaacaauauggcgacugucuuggggauauugcagccagggacuugaucugcgcucagaaguucaacggacugaccguccugcccccacucuuaacagaugaaaugauugcccaguacacgucagcacugcuugcuggcaccaucacuagcgguuggacauuuggggccggcgcggccuugcagauaccuuucgcuaugcaaauggcauaucguuuuaauggaauuggcgugacccagaacgugcucuacgagaaucagaaacugaucgccaaccaguucaacuccgcuauugggaagauccaagacucucuaagcuccacagccucagcacugggaaaacuccaggacgucguuaaucagaacgcgcaggcccugaauacucuugugaagcaauugagcaguaacuuuggcgcuauaucuuccguacugaaugauaucuuaagccggcucgacaagguggaagccgagguccagauugaucgacugaucaccgguagacuucagucgcugcaaacguaugugacacagcaguugauuagggcagcugagauccgcgccucagcaaaccucgccgcuaccaaaaugucugaaugcguucuggggcagaguaagcggguggacuucuguggaaaaggcuaccaccuaauguccuuuccccaaagcgcgccacauggugucguguuccugcacguuacuuacgugccggcccaggagaagaauuuuaccacagcuccugcaauaugccacgauggcaaagcccauuuccccagagaaggggucuuuguaucuaacggaacucacugguucgugacccagaggaauuuuuaugagccacagauuaucacaacggacaacaccuucguuagcggcaauugugauguggucaucgggauugugaacaauacuguauacgacccccuccaaccugagcuggauuccuucaaggaggaacuugacaaauauuuuaagaaccauacaucaccagauguggacuugggagauaucaguggcauuaaugccagcgucguuaacauacagaaggaaaucgaccgccugaaugagguggcuaaaaacuuaaacgaaucucucauugaccugcaggagcuugguaaguacgagcaguauaucaaauggcccugguacauuuggcugggguucaucgcaggacuaauagccaucgugauggucaccauuaugcucugcuguaugacuuccugcuguucaugccugaagggcuguugcaguugugguagcugcugcaaauuugaugaagacgauuccgagccuguguugaagggcguuaagcugcacuauacaugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12536 - RNA, 4076 nt, Artificial Sequence
  SARS-CoV-2/pangolin/Guangxi/P4L/2017__EPI_ISL_410538 spike protein mRNA human (1-1267)
aggagagucccgcagucggcguccagcggcucugcuuguucgugugugugucguugcaggccuuauucaagcuuaccauguucguguuucuguucguccucccccuuguuagcucccagugcgugaaccugaccacaagaacuggcaucccuccaggguacacgaauagcucaaccaggggaguauauuacccggacaagguguuucggaguagcauuuugcacuuaacacaagaucuguuccuacccuuuuucuccaacgucacuugguuuaauaccauaaacuaucaggguggcuucaaaaaguuugacaauccugugcucccauucaacgaugggguuuacuuugccucuacagagaaaucgaauaucauucgcggauggaucuucggcaccacucuggacgcucgaacacagucacuucugauugugaacaaugcaaccaacgucgugaucaagguaugugaauuucaguucugcacggaucccuucuuggguguuuauuaccauaauaacaauaaaacuuggguggagaacgaauuucgugucuauagcagugccaauaacuguaccuucgaguacauaucccaaccuuuucucauggaccuggaagggaagcagggaaacuucaagaaucugagagaguuuguguucaaaaacguggauggcuacuuuaagaucuauucuaaacacacaccaauugaccucgucagggauuuaccccggggcuucgcggcucuggagccucuuguugacuugccaaucgggauuaauaucacucgcuuucagacccugcuagcccuccauagaagcuaccugacaccgggaaaccuugaauccgguuggaccacgggcgcagccgcuuauuacgugggguaucugcagcaaaggacuuucuugcucucauacaaucagaacggaacaauaaccgaugcaguagacugcagucuggaucccuuaagcgagacuaaguguacacugaaaucucucaccguggaaaagggcauuuaucagacguccaauuuucggguccagccuaccaucucaauugugcgcuucccaaacaucacaaaucuuugccccuuuggugagguuuucaacgccagcaaguucgcuaguguguacgccuggaaucgaaaaagaaucucuaacugugucgcggacuacuccgugcuguauaauagcacuucguuuucuaccuucaagugcuacgggguauccccuacaaaauugaacgaccuauguuuuacuaauguuuaugcagauucauucguggucaagggagacgaggugaggcaaauugccccaggccagaccggcgucauagcugauuacaacuauaaacugcccgacgauuuuacagggugcgugaucgccuggaacaguguuaagcaggacgcacucaccggagguaauuacggcuaucuguaccggcuuuuccguaaaagcaagcugaagccguuugaacgcgauauuuccacugagaucuaccaagcugggucuacgccuuguaacggacaggugggcuugaauugcuauuacccccucgaaagauaugguuuccacccaacaaccgggguaaacuaccagccuuuuagggucgugguucugagcuucgaguuacugaauggccccgccacugugugcggaccaaaacuaucaaccacacucgucaaggacaaaugugugaacuuuaauuucaacggccugaccgggacuggaguacuuacaacgaguaagaaacaguuuuugcccuuccaacaguucggucgggauauauccgacaccacugaugcggugcgagacccucagacacuggaaauucucgacaucaccccaugcagcuuuggcgggguuucugucaucacaccgggaacuaauaccucaaaccagguggccgugcuguaucaagaugucaauuguacggagguucccauggcaauucaugcugagcagcuuaccccugccuggcgcguguacagugcuggcgccaacguguuccagacaagagcagguugccugguaggggccgaacacgucaauaacagcuaugagugugacaucccagugggcgcuggaauuugcgcguccuaccacucuaugucgagcuugagguccguuaaucagcggucaauaaucgcauacacuaugagucucggcgccgaaaacucuguggcuuauagcaacaauuccauugccauccccaccaacuuuacaaucucagucacuaccgagauucugccugugagcaugacgaagacaucuguugauuguaccauguacauaugcggggacuccaucgaauguaguaauuuacugcuacaauauggaucuuucugcacucagcucaaccgcgcacugacagguauugccguggagcaggauaagaauacccaggagguauuugcucaagucaaacagaucuacaagacuccacccauuaaagacuucggcggguuuaacuucucucagauccuuccggauccuuccaagccaucaaaaagaaguuuuauagaagacuugcuguucaauaaggugacccucgccgaugcaggauuuaucaagcaauauggcgacugucugggugauauugcggcuagggacuuaaucugcgcccagaaauucaacgggcugacagugcuucccccuuugcucacggaugagaugauugcacaguacaccagcgcccugcuagcuggcacuaucacaucgggauggaccuucggcgccggggcagcucugcagauacccuuugccaugcaaauggcguaucguuucaauggaauuggcgucacacagaacguucucuacgaaaaucagaagcugaucgccaaccaguuuaauuccgcuauugguaaaauccaagacucucuuagcucaacugcaagugccuuggggaagcugcaggacgugguaaaccagaaugcucaggccuuaaacacccucgugaaacaacuguccucuaacuucggagcaauaagcuccguccuuaaugauauccugucacgguuggacaagguggaggcggaaguucagauugaucgacucaucacgggcagacugcagagccuacaaacauacgugacccagcagcugauuagggccgcugagauccgcgccagugcaaaccucgcugccacuaagaugucugagugcguccugggucaguccaaacggguggacuuuuguggcaagggguaucaucuuaugagcuucccacaaucggcaccucacggaguuguguuuuugcaugucaccuacguacccgcccaggagaaaaauuucacaacugcuccagcgauaugccacgagggcaaggcccacuuuccgagagaagggguguucguuucaaacggaacccauugguuuauuacacagaggaauuucuaugagccucagaucaucacgaccgauaacacuuuugugucuggcaguugugacgucgugauugguaucguaaauaacacaguguacgauccccugcaaccagaguuagacuccuucaaagaagaacucgauaaguauuucaaaaaucacaccagccccgacgucgaucugggggacauuucuggaauaaacgcaagcguugugaauauccagaaggaaauugaucgccuuaacgagguggcuaagaaucugaacgaauccccuaucgaccuacaggagcucggcaaauacgagcaguauauuaaguggccaugguacaucuggcuggguuuuauagccggcuugaucgccauuaucauggucacuauuaugcugugcuguaugacaucaugcuguaguugcuuaaaaggguguugcagcuguggaucuugcugcaaguucgacgaagaugacuccgagcccgugcucaaaggcguuaagcugcauuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12537 - RNA, 4076 nt, Artificial Sequence
  SARS-CoV-2/pangolin/Guangxi/P5L/2017__EPI_ISL_410540 spike protein mRNA human (1-1267)
aggagagucccgcagucggcguccagcggcucugcuuguucgugugugugucguugcaggccuuauucaagcuuaccauguucguguuucuguucguccucccccuuguuagcucccagugcgugaaccugaccacaagaacuggcaucccuccaggguacacgaauagcucaaccaggggaguauauuacccggacaagguguuucggaguagcauuuugcacuuaacacaagaucuguuccuacccuuuuucuccaacgucacuugguuuaauaccauaaacuaucaggguggcuucaaaaaguuugacaauccugugcucccauucaacgaugggguuuacuuugccucuacagagaaaucgaauaucauucgcggauggaucuucggcaccacucuggacgcucgaacacagucacuucugauugugaacaaugcaaccaacgucgugaucaagguaugugaauuucaguucugcacggaucccuucuuggguguuuauuaccauaauaacaauaaaacuuggguggagaacgaauuucgugucuauagcagugccaauaacuguaccuucgaguacauaucccaaccuuuucucauggaccuggaagggaagcagggaaacuucaagaaucugagagaguuuguguucaaaaacguggauggcuacuuuaagaucuauucuaaacacacaccaauugaccucgucagggauuuaccccggggcuucgcggcucuggagccucuuguugacuugccaaucgggauuaauaucacucgcuuucagacccugcuagcccuccauagaagcuaccugacaccgggaaaacuugaauccgguuggaccacgggcgcagccgcuuauuacgugggguaucugcagcaaaggacuuucuugcucucauacaaccagaauggaacaauaaccgaugcaguagacugcagucuggaucccuuaagcgagacuaaguguacacugaagucucucaccguggaaaagggcauuuaucagacguccaacuuucggguccagccuaccaucucaauugugcgcuucccaaauaucacaaaccuuugccccuuuggugagguuuucaaugccagcaaauucgcuaguguguacgccuggaaccgaaagagaaucucuaauugugucgcggacuacuccgugcuguauaacagcacuucguuuucuaccuucaaaugcuacgggguauccccuacaaaguugaaugaccuauguuuuacuaacguuuaugcagauucauucguggucaaaggagacgaggugaggcaaauugccccaggccagaccggcgucauagcugauuacaauuauaagcugcccgacgauuuuacagggugcgugaucgccuggaacaguguuaaacaggacgcacucaccggagguaacuacggcuaucuguaccggcuuuuccguaagagcaagcugaaaccguuugaacgcgauauuuccacugagaucuaccaagcugggucuacgccuuguaauggacaggugggcuugaacugcuauuacccccucgaaagauaugguuuccacccaacaaccgggguaaauuaccagccuuuuagggucgugguucugagcuucgaguuacugaacggccccgccacugugugcggaccaaagcuaucaaccacacucgucaaagacaagugugugaauuuuaacuucaauggccugaccgggacuggaguacuuacaacgaguaaaaagcaguuuuugcccuuccaacaguucggucgggauauauccgacaccacugaugcggugcgagacccucagacacuggaaauucucgacaucaccccaugcagcuuuggcgggguuucugucaucacaccgggaacuaacaccucaaaucagguggccgugcuguaucaagaugucaacuguacggagguucccauggcaauucaugcugagcagcuuaccccugccuggcgcguguacagugcuggcgccaauguguuccagacaagagcagguugccugguaggggccgaacacgucaacaauagcuaugagugugacaucccagugggcgcuggaauuugcgcguccuaccacucuaugucgagcuuuagguccguuaaccagcggucaauaaucgcauacacuaugaguuugggcgccgaaaauucuguggcuuauagcaacaacuccauugccauccccaccaauuucacaaucucagucacuaccgagauucucccugugagcaugacgaagacaucuguugauuguaccauguacauaugcggggacuccaucgaauguaguaaccuguuacugcaauauggaucuuuuugcacucagcuaaaucgcgcacucacagguauugccguggagcaggauaaaaacacccaggagguauucgcucaagucaagcagaucuacaaaacuccacccauuaaggacuuuggcggguucaauuuuucucagauccugccggauccuuccaaaccaucaaagagaaguuucauagaagaccuuuuguuuaacaaggugacccuggccgaugcaggauucaucaaacaauauggcgacugucucggugauauugcggcuagggaccugaucugcgcccagaaguucaauggguuaacagugcugcccccucuuuugacggaugagaugauugcacaguacaccagcgcccuccuggcuggcacuaucacaucgggauggaccuuuggcgccggggcagcucuacagauacccuucgccaugcaaauggcguaucguuuuaacggaauuggcgucacacagaauguucuguacgaaaaccagaaacucaucgccaaucaguucaacuccgcuauugguaagauccaagacucucugagcucaacugcaagugcccuugggaaauugcaggacgugguaaaucagaacgcucaggcccugaauaccuuagugaagcaacucuccucuaacuuuggagcaauaagcuccguccugaacgauauccuuucacggcuggacaagguggaggcggaaguucagauugaucgauugaucacgggcagacuccagagccugcaaacauacgugacccagcagcuaauuagggccgcugagauccgcgccagugcaaaucuggcugccacuaaaaugucugagugcguccucggucaguccaagcggguggacuucuguggcaaaggguaucaucugaugagcuuuccacaaucggcaccucacggaguuguguuccuucaugucaccuacguacccgcccaggaaaagaacuuuacaacugcuccagcgauaugccacgagggcaaagcccacuucccgagagaagggguguuuguuucaaauggaacccauugguucauuacacagaggaacuuuuaugagccucagaucaucacgaccgauaauacuuucgugucuggcaguugugacgucgugauugguaucguaaacaauacaguguacgaucccuugcaaccagagcuggacuccuucaaggaagaguuagauaaauauuuuaagaaccacaccagccccgacgucgaucucggggacauuucuggaauaaaugcaagcguugugaacauccagaaggaaauugaucgccugaaugagguggcuaaaaaccuuaaugaaucccugaucgaccuacaggagcucggcaaguacgagcaguauauuaaauggccuugguacaucuggcuggguuucauagccggcuugaucgccauuaucauggucacuauuaugcugugcuguaugacaucaugcuguaguugcuuaaagggguguugcagcuguggaucuugcugcaaauuugacgaagaugacuccgagccagugcucaagggcguuaagcugcauuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12538 - RNA, 4076 nt, Artificial Sequence
  SARS-CoV-2/pangolin/Guangxi/P5E/2017__EPI_ISL_410541 spike protein mRNA human (1-1267)
aggagagucccgcagucggcguccagcggcucugcuuguucgugugugugucguugcaggccuuauucaagcuuaccauguucguguuucuguucguccucccccuuguuagcucccagugcgugaaccugaccacaagaacuggcaucccuccaggguacacaaauucuucaaccaggggaguauauuacccggacaagguguuucggaguagcauuuugcacuuaacacaagaucuguuccuacccuuuuucuccaacgucacuugguuuaauaccauaacauaucaggguggcucuaaaaaguucgacaacccugugcucccauuuaaugaugggguuuacuucgccucgaccgagaaaucaaacaucauucgcggauggaucuuuggcacuacacuggacgcucgaacccagagccuucugauugugaauaacgcaacgaaugucgugaucaagguaugugaguuccaguuuugcacugaucccuucuuggguguuuauuaccauaacaauaacaaaaccuggguggaaaaugaguuccgugucuauaguuccgccaacaauuguacauuugaauacauaucucaaccuuuccucauggaccuggaagggaagcagggaaacuuuaagaaccugagagaguucguguuuaaaaauguggauggcuacuucaagaucuauagcaaacacacuccaauugaccucgucagggauuuaccccggggcuuugcggcucuggagccucuuguugacuugccaaucgggauuaacaucacccgcuuccagacacugcuagcccuccauagauccuaccugaccccgggaaaacuugaaucagguuggacgacuggcgcagccgcuuauuacgugggguaucugcagcaaaggacauuuuugcucaguuacaaucagaacggaaccauaacugaugcaguagacugcagccuggaucccuuaucugagacaaaguguacccugaagucccucacgguggaaaagggcauuuaucagaccucaaauuuccggguccagccuacaaucagcauugugcgcuuuccaaacaucacuaaucuuugccccuucggugagguuuuuaacgccaguaaauucgcuucuguguacgccuggaaucgaaagagaaucuccaacugugucgcggacuacagcgugcuguauaauucgaccucuuucuccacauuuaaaugcuacgggguaucaccuacuaaguugaacgaccuauguuucaccaauguuuaugcagauaguuuuguggucaaaggagacgaggugaggcaaauugccccaggccagacaggcgucauagcugauuacaacuauaagcugcccgacgauuucaccgggugcgugaucgccuggaauagcguuaaacaggacgcacucacuggagauaacuacgguuaucuguaccggcuuuuucguaaguccaagcugaaaccguucgaacgcgacauuucuacggagaucuaccaagcuggcagcacaccuuguaacggacaggugggguugaauugcuauuacccccucgaaagauauggcuuucacccaaccacugguguaaacuaccagccuuucagggucgugguucugucauuugaguuacugaaugggcccgccaccgugugcggcccaaagcuaaguacaacccucgucaaagauaagugugugaacuucaauuuuaacggacugacuggcacagggguacuuacgaccuccaaaaagcaguucuugcccuuucaacaguucggacgggacauaagcgauacuacagacgcggugcgagacccucagacccuggaaauucucgauaucacaccaugcucuuucgguggcguuucagucaucacuccggggaccaauacgaguaaccagguggccgugcuguaucaagacgucaauuguaccgagguucccauggcaauucaugcugagcagcuuacgccugccuggcgcguguacagcgcuggagccaacguguuucagacuagagcaggcugccugguaggugccgaacacgucaauaacuccuaugagugugauaucccagugggggcuggcauuugcgcgucuuaccacucgaugagcuccuucaggucaguuaaucagcggaguauaaucgcauacaccaugucuuugggagccgaaaacagcguggcuuauuccaauaacucaauugccauccccacaaacuuuacuaucagcgucaccacggagauucucccugugucuaugacaaagaccuccguugacuguacuauguacauaugcggcgauaguaucgaauguagcaaucuguuacugcaauaugggucuuucugcacacagcuaaaccgcgcacucaccggaauugccguggagcaggacaaaaauacucaggagguauuugcucaagucaagcagaucuacaaaaccccacccauuaaggauuucgguggcuuuaacuucucccagauccugccggacccuucaaaaccaaguaagaggagcuuuauagaagaucuuuuguucaauaaggugacacuggccgacgcaggguuuaucaaacaauauggagauugucucggcgacauugcggcuagagaucugaucugcgcccagaaguucaacgguuuaacggugcugcccccucuuuugaccgacgagaugauugcacaguacacuucggcccuccuggcugggacaaucaccuccggcuggacauucggagccggcgcagcucuacagauacccuuugccaugcaaauggcguaucguuucaaugggauuggagucacucagaacguucuguacgaaaaucagaaacucaucgccaaccaguuuaauucugcuauuggcaagauccaagacagccugucaaguaccgcauccgcccuugguaaauugcaggaugugguaaaccagaaugcucaggcccugaacacguuagugaagcaacucucuagcaauuucggggcaauauccucaguccugaacgacauccuuagccggcuggauaagguggaggcggaaguucagauugaccgauugaucacaggaagacuccagagucugcaaaccuacgugacucagcagcuaauuagggccgcugagauccgcgccucugcaaaccuggcugccaccaaaauguccgagugcguccucggccagagcaagcggguggauuuuugugguaaaggcuaucaucugaugucguucccacaaucagcaccucacgggguuguguuucuucaugucacauacguacccgcccaggaaaagaauuucacuaccgcuccagcgauaugccacgagggaaaagcccacuuuccgagagaaggcguguucguuucuaacgggacacauugguuuauuacgcagaggaauuucuaugagccucagaucaucaccacugacaacacauuugugaguggauccugugaugucgugauuggcaucguaaauaacaccguguacgaccccuugcaaccagagcuggauagcuucaaggaagaguuagacaaauauuucaagaaucacacuucucccgaugucgaccucggugauauuagcgggauaaacgcauccguugugaauauccagaaggaaauugaccgccugaacgagguggcuaaaaaucuuaacgaaucacugaucgaccuacaggagcucggaaaguacgagcaguauauuaaauggccuugguacaucuggcugggcuuuauagccgguuugaucgccauuaucauggucacaauuaugcugugcuguaugaccaguugcuguagcugcuuaaagggcuguugcucuuguggguccugcugcaaauucgaugaagacgauucagagccagugcucaagggaguuaagcugcauuacacgugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12539 - RNA, 4070 nt, Artificial Sequence
  SARS-CoV-2/pangolin/Guangxi/P1E/2017__EPI_ISL_410539 spike protein mRNA human (1-1265)
aggagagucccgcagucggcguccagcggcucugcuuguucgugugugugucguugcaggccuuauucaagcuuaccauguucguguuucuguucguccucccccuuguuagcucccagugcgugaaccugaccacaagaacuggcauccaaccuggguacaccaauucuucaacgaggggaguauauuacccagacaagguguuucggaguagcauuuugcacuuaacacaggaucuguuccuaccguuuuucuccaacgucacuugguuuaauaccauaaacuaucaggguggcuucaagaaguuugacaaucccgugcucccuuucaacgaugggguuuacuuugccucuacagagaaaucgaauaucauucgcggauggaucuucggcaccacucuggacgcucgaacacagucacuucugauugugaacaaugcaaccaacgucgugaucaagguaugugaauuucaauucugcacggauccauucuuggguguuuauuaccauaauaacaauaaaacuuggguggagaacgaauuucgugucuauagcagugccaauaacuguaccuucgaguacauaucccagcccuuucucauggaccuggaagggaagcagggaaacuucaagaaucugagagaguuuguguucaaaaacguggauggcuacuuuaagaucuauucuaaacacacaccuauugaccucgucagggauuuaccacggggcuucgcggcucuggagccccuuguugacuugccuaucgggauuaauaucacucgcuuucagacccugcuagcccuccauagaagcuaccugacaccaggaaaacuugaauccgguuggaccacgggcgcagccgcuuauuacgugggguaucugcaacagaggacuuucuugcucucauacaaccagaauggaacaauaaccgaugcaguagacugcagucuggauccguuaagcgagacuaaguguacacugaagucucucaccguggaaaagggcauuuaucagacguccaacuuucggguccaacccaccaucucaauugugcgcuucccuaauaucacaaaccuuugcccauuuggugagguuuucaaugccagcaaauucgcuaguguguacgccuggaaccgaaagagaaucucuaauugugucgcggacuacuccgugcuguauaacagcacuucguuuucuaccuucaaaugcuacgggguaucccccacaaaguugaaugaccuauguuuuacuaacguuuaugcagauucauucguggucaaaggagacgaggugaggcagauugccccuggccagaccggcgucauagcugauuacaauuauaagcugccagacgauuuuacagggugcgugaucgccuggaacaguguuaaacaagacgcacucaccggagguaacuaccuguaucggcuuuuccguaagagcaagcugaaacccuuugaacgcgauauuuccacugagaucuaccaggcuggcucuacgccguguaauggacaggugggguugaacugcuacuauccucucgaaagauacggcuuccaccccacaaccgguguaaauuaucagccauuuagggucgugguucugagcuucgaguuacugaacgggccugccacugugugcggccccaagcuaucaaccacacucgucaaagacaagugugugaauuuuaacuucaauggacugaccggcacugggguacuuacaacgaguaaaaagcaauuuuugccauuccagcaguucggacgggauauauccgacaccacugaugcggugcgagacccccagacacuggaaauucucgacaucaccccuugcagcuuugguggcguuucugucaucacaccagggacuaacaccucaaaucaaguggccgugcuguaccaggaugucaacuguacggagguuccgauggcaauucaugcugagcagcuuacccccgccuggcgcguguauagugcuggagccaauguguuccagacaagagcaggcugccugguaggugccgaacacgucaacaauagcuacgagugugacaucccugugggggcuggcauuugcgcguccuaucacucuaugucgagcuugagguccguuaaccaacggucaauaaucgcauacacuaugagucucggagccgaaaauucuguggcuuacagcaacaacuccauugccaucccaaccaauuuuacaaucucagucacuaccgagauucugcccgugagcaugacgaagacaucuguugauuguaccauguauauaugcggcgacuccaucgaauguaguaacuuacugcuacaguacgggagcuucugcacucagcucaaucgcgcacugacaggaauugccguggagcaggauaaaaacacccaagagguauuugcucaggucaagcagaucuauaaaacuccuccaauuaaggacuucgguggcuuuaauuucucucaaauccuucccgauccguccaaaccuucaaagagaaguuuuauagaagacuugcuguucaacaaggugacccucgccgaugcaggguuuaucaaacaguacggagacugucugggcgauauugcggcuagggacuuaaucugcgcccagaaguucaauggucugacagugcuuccacccuugcucacggaugagaugauugcacaguauaccagcgcccugcuagcugggacuaucacaucgggcuggaccuucggagccggcgcagcucugcaaauaccuuuugccaugcagauggcguaccguuucaacgggauuggagucacacagaauguucucuaugaaaaccagaaacugaucgccaaucaauuuaacuccgcuauuggcaagauccaggacucucuuagcucaacugcaagugccuuggguaaacugcaggacgugguaaaucagaacgcucaagccuuaaauacccucgugaagcagcuguccucuaacuucggggcaauaagcuccguccuuaacgauauccugucacgguuggacaagguggaggcggaaguucagauugaucgacucaucacgggaagacugcaaagccuacagacauacgugacccagcagcugauuagggccgcugagauccgcgccagugcaaaucucgcugccacuaaaaugucugagugcguccugggccaauccaagcggguggacuuuugugguaaaggcuaccaucuuaugagcuucccccagucggcaccacacgggguuguguuuuugcaugucaccuauguaccugcccaggaaaagaacuucacaacugcucccgcgauaugccacgagggaaaagcccacuuuccaagagaaggcguguucguuucaaaugggacccauugguuuauuacacagaggaacuucuacgagccgcaaaucaucacgaccgauaauacuuuugugucuggaaguugugacgucgugauuggcaucguaaacaauacaguguaugauccucugcagcccgaguuagacuccuucaaggaggaacucgauaaauacuucaagaaccacaccagcccagacgucgaucugggugacauuucugggauaaaugcaagcguugugaacauccagaaggaaauugaucgccuuaaugagguggcuaaaaaccugaaugaaucccuaaucgaccuccaggagcugggaaaguaugagcaauacauuaaauggcccugguauaucugguugggcuuuauagccggucugaucgccauuaucauggucacuauuauguuaugcuguaugacaucaugcuguaguugccucaagggcuguugcagcugugggucuugcugcaaauucgacgaagaugacuccgagccugugcugaagggaguuaaacuucauuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12540 - RNA, 4094 nt, Artificial Sequence
  SARS-CoV-2/Wuhan/WIV05/2019__EPI_ISL_402128 spike protein mRNA gc mod (1-1273)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12541 - RNA, 4094 nt, Artificial Sequence; identical to SEQ ID NO: 151
  SARS-CoV-2/Wuhan/WIV05/2019__EPI_ISL_402128 spike protein mRNA gc mod (1-1273)(K986P_V987P) R10162

SEQ ID NO: 12542 - RNA, 4094 nt, Artificial Sequence
  SARS-CoV-2/Wuhan/WIV05/2019__EPI_ISL_402128 spike protein mRNA gc mod (1-1273)(K986P_V987P_T887WN_A1020W)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggugguuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagauggucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12543 - RNA, 4094 nt, Artificial Sequence
  SARS-CoV-2/Wuhan/WIV05/2019__EPI_ISL_402128 spike protein mRNA gc mod (1-1273)(K986P_V987P_P1069F)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauauguguucgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12544 - RNA, 4094 nt, Artificial Sequence
  SARS-CoV-2/Wuhan/WIV05/2019__EPI_ISL_402128 spike protein mRNA gc mod (1-1273)(K986P_V987P_ H1048Q_H1064N_ H1083N_H1101N)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccagcugaugagcuucccucagucugccccucacggcgugguguuucugaacgugacauaugugcccgcucaagagaagaauuucaccaccgcuccagccaucugcaacgacggcaaagcccacuuuccuagagaaggcguguucguguccaacggcaccaacugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12545 - RNA, 4094 nt, Artificial Sequence
  SARS-CoV-2/Wuhan/WIV05/2019__EPI_ISL_402128 spike protein mRNA gc mod (1-1273)(I712C_T1077C)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuugcgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccugugcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12546 - RNA, 4094 nt, Artificial Sequence
  SARS-CoV-2/Wuhan/WIV05/2019__EPI_ISL_402128 spike protein mRNA gc mod (1-1273)(I714C_Y1110C)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuugccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucugugagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12547 - RNA, 4094 nt, Artificial Sequence
  SARS-CoV-2/Wuhan/WIV05/2019__EPI_ISL_402128 spike protein mRNA gc mod (1-1273)(P715C_P1069C)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuaucugcaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugugugcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12548 - RNA, 4094 nt, Artificial Sequence
  SARS-CoV-2/Wuhan/WIV05/2019__EPI_ISL_402128 spike protein mRNA gc mod (1-1273)(G889C_L1034C)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuugcgcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugaguguguguguggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12549 - RNA, 4094 nt, Artificial Sequence
  SARS-CoV-2/Wuhan/WIV05/2019__EPI_ISL_402128 spike protein mRNA gc mod (1-1273)(I909C_Y1047C)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcugcggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcugucaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12550 - RNA, 4094 nt, Artificial Sequence
  SARS-CoV-2/Wuhan/WIV05/2019__EPI_ISL_402128 spike protein mRNA gc mod (1-1273)(Q965C_S1003C)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagugccuguccuccaacuucggcgccaucagcucugugcugaacgauauccugagcagacuggacaaggucgaggccgaggugcagaucgacagacugaucacaggcagacugcagugucuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12551 - RNA, 4094 nt, Artificial Sequence
  SARS-CoV-2/Wuhan/WIV05/2019__EPI_ISL_402128 spike protein mRNA gc mod (1-1273)(F970C_G999C)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacugcggcgccaucagcucugugcugaacgauauccugagcagacuggacaaggucgaggccgaggugcagaucgacagacugaucacauguagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12552 - RNA, 4094 nt, Artificial Sequence
  SARS-CoV-2/Wuhan/WIV05/2019__EPI_ISL_402128 spike protein mRNA gc mod (1-1273)(A972C_R995C)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcugcaucagcucugugcugaacgauauccugagcagacuggacaaggucgaggccgaggugcagaucgacugucugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12553 - RNA, 4094 nt, Artificial Sequence
  SARS-CoV-2/Wuhan/WIV05/2019__EPI_ISL_402128 spike protein mRNA gc mod (1-1273)(A890C_V1040C)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggaugcggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaugugacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12554 - RNA, 4094 nt, Artificial Sequence
  SARS-CoV-2/Wuhan/WIV05/2019__EPI_ISL_402128 spike protein mRNA gc mod (1-1273)(T874C_S1055C)
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacugcucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagugcgccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12555 - RNA, 2318 nt, Artificial Sequence; identical to SEQ ID NO: 154
  SARS-CoV-2/Wuhan/WIV05/2019__EPI_ISL_402128 spike protein mRNA gc mod (1-681)

SEQ ID NO: 12556 - RNA, 4388 nt, Artificial Sequence
  SARS-CoV-2/Wuhan/WIV05/2019__EPI_ISL_402128 spike protein mRNA gc mod (1-1211) LumSynth construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12557 - RNA, 4388 nt, Artificial Sequence
  SARS-CoV-2/Wuhan/WIV05/2019__EPI_ISL_402128 spike protein mRNA gc mod (1-1211)(K986P_V987P) LumSynth construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12558 - RNA, 4388 nt, Artificial Sequence
  SARS-CoV-2/Wuhan/WIV05/2019__EPI_ISL_402128 spike protein mRNA gc mod (1-1211)(K986P_V987P_T887WN_A1020W) LumSynth construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggugguuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagauggucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12559 - RNA, 4388 nt, Artificial Sequence
  SARS-CoV-2/Wuhan/WIV05/2019__EPI_ISL_402128 spike protein mRNA gc mod (1-1211)(K986P_V987P_P1069F) LumSynth construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauauguguucgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12560 - RNA, 4388 nt, Artificial Sequence
  SARS-CoV-2/Wuhan/WIV05/2019__EPI_ISL_402128 spike protein mRNA gc mod (1-1211)(K986P_V987P_ H1048Q_H1064N_ H1083N_H1101N) LumSynth construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccagcugaugagcuucccucagucugccccucacggcgugguguuucugaacgugacauaugugcccgcucaagagaagaauuucaccaccgcuccagccaucugcaacgacggcaaagcccacuuuccuagagaaggcguguucguguccaacggcaccaacugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12561 - RNA, 4388 nt, Artificial Sequence
  SARS-CoV-2/Wuhan/WIV05/2019__EPI_ISL_402128 spike protein mRNA gc mod (1-1211)(I712C_T1077C) LumSynth construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuugcgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccugugcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12562 - RNA, 4388 nt, Artificial Sequence
  SARS-CoV-2/Wuhan/WIV05/2019__EPI_ISL_402128 spike protein mRNA gc mod (1-1211)(I714C_Y1110C) LumSynth construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuugccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucugugagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12563 - RNA, 4388 nt, Artificial Sequence
  SARS-CoV-2/Wuhan/WIV05/2019__EPI_ISL_402128 spike protein mRNA gc mod (1-1211)(P715C_P1069C) LumSynth construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuaucugcaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugugugcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12564 - RNA, 4388 nt, Artificial Sequence
  SARS-CoV-2/Wuhan/WIV05/2019__EPI_ISL_402128 spike protein mRNA gc mod (1-1211)(G889C_L1034C) LumSynth construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuugcgcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugaguguguguguggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12565 - RNA, 4388 nt, Artificial Sequence
  SARS-CoV-2/Wuhan/WIV05/2019__EPI_ISL_402128 spike protein mRNA gc mod (1-1211)(I909C_Y1047C) LumSynth construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcugcggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcugucaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12566 - RNA, 4388 nt, Artificial Sequence
  SARS-CoV-2/Wuhan/WIV05/2019__EPI_ISL_402128 spike protein mRNA gc mod (1-1211)(Q965C_S1003C) LumSynth construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagugccuguccuccaacuucggcgccaucagcucugugcugaacgauauccugagcagacuggacaaggucgaggccgaggugcagaucgacagacugaucacaggcagacugcagugucuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12567 - RNA, 4388 nt, Artificial Sequence
  SARS-CoV-2/Wuhan/WIV05/2019__EPI_ISL_402128 spike protein mRNA gc mod (1-1211)(F970C_G999C) LumSynth construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacugcggcgccaucagcucugugcugaacgauauccugagcagacuggacaaggucgaggccgaggugcagaucgacagacugaucacauguagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12568 - RNA, 4388 nt, Artificial Sequence
  SARS-CoV-2/Wuhan/WIV05/2019__EPI_ISL_402128 spike protein mRNA gc mod (1-1211)(A972C_R995C) LumSynth construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcugcaucagcucugugcugaacgauauccugagcagacuggacaaggucgaggccgaggugcagaucgacugucugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12569 - RNA, 4388 nt, Artificial Sequence
  SARS-CoV-2/Wuhan/WIV05/2019__EPI_ISL_402128 spike protein mRNA gc mod (1-1211)(A890C_V1040C) LumSynth construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggaugcggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaugugacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12570 - RNA, 4388 nt, Artificial Sequence
  SARS-CoV-2/Wuhan/WIV05/2019__EPI_ISL_402128 spike protein mRNA gc mod (1-1211)(T874C_S1055C) LumSynth construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacugcucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagugcgccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12571 - RNA, 4412 nt, Artificial Sequence
  SARS-CoV-2/Wuhan/WIV05/2019__EPI_ISL_402128 spike protein mRNA gc mod (1-1211) Ferritin construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12572 - RNA, 4412 nt, Artificial Sequence
  SARS-CoV-2/Wuhan/WIV05/2019__EPI_ISL_402128 spike protein mRNA gc mod (1-1211)(K986P_V987P) Ferritin construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12573 - RNA, 4412 nt, Artificial Sequence
  SARS-CoV-2/Wuhan/WIV05/2019__EPI_ISL_402128 spike protein mRNA gc mod (1-1211)(K986P_V987P_T887WN_A1020W) Ferritin construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggugguuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagauggucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12574 - RNA, 4412 nt, Artificial Sequence
  SARS-CoV-2/Wuhan/WIV05/2019__EPI_ISL_402128 spike protein mRNA gc mod (1-1211)(K986P_V987P_P1069F) Ferritin construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauauguguucgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12575 - RNA, 4412 nt, Artificial Sequence
  SARS-CoV-2/Wuhan/WIV05/2019__EPI_ISL_402128 spike protein mRNA gc mod (1-1211)(K986P_V987P_ H1048Q_H1064N_ H1083N_H1101N) Ferritin construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccagcugaugagcuucccucagucugccccucacggcgugguguuucugaacgugacauaugugcccgcucaagagaagaauuucaccaccgcuccagccaucugcaacgacggcaaagcccacuuuccuagagaaggcguguucguguccaacggcaccaacugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12576 - RNA, 4412 nt, Artificial Sequence
  SARS-CoV-2/Wuhan/WIV05/2019__EPI_ISL_402128 spike protein mRNA gc mod (1-1211)(I712C_T1077C) Ferritin construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuugcgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccugugcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12577 - RNA, 4412 nt, Artificial Sequence
  SARS-CoV-2/Wuhan/WIV05/2019__EPI_ISL_402128 spike protein mRNA gc mod (1-1211)(I714C_Y1110C) Ferritin construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuugccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucugugagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12578 - RNA, 4412 nt, Artificial Sequence
  SARS-CoV-2/Wuhan/WIV05/2019__EPI_ISL_402128 spike protein mRNA gc mod (1-1211)(P715C_P1069C) Ferritin construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuaucugcaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugugugcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12579 - RNA, 4412 nt, Artificial Sequence
  SARS-CoV-2/Wuhan/WIV05/2019__EPI_ISL_402128 spike protein mRNA gc mod (1-1211)(G889C_L1034C) Ferritin construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuugcgcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugaguguguguguggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12580 - RNA, 4412 nt, Artificial Sequence
  SARS-CoV-2/Wuhan/WIV05/2019__EPI_ISL_402128 spike protein mRNA gc mod (1-1211)(I909C_Y1047C) Ferritin construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcugcggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcugucaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12581 - RNA, 4412 nt, Artificial Sequence
  SARS-CoV-2/Wuhan/WIV05/2019__EPI_ISL_402128 spike protein mRNA gc mod (1-1211)(Q965C_S1003C) Ferritin construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagugccuguccuccaacuucggcgccaucagcucugugcugaacgauauccugagcagacuggacaaggucgaggccgaggugcagaucgacagacugaucacaggcagacugcagugucuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12582 - RNA, 4412 nt, Artificial Sequence
  SARS-CoV-2/Wuhan/WIV05/2019__EPI_ISL_402128 spike protein mRNA gc mod (1-1211)(F970C_G999C) Ferritin construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacugcggcgccaucagcucugugcugaacgauauccugagcagacuggacaaggucgaggccgaggugcagaucgacagacugaucacauguagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12583 - RNA, 4412 nt, Artificial Sequence
  SARS-CoV-2/Wuhan/WIV05/2019__EPI_ISL_402128 spike protein mRNA gc mod (1-1211)(A972C_R995C) Ferritin construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcugcaucagcucugugcugaacgauauccugagcagacuggacaaggucgaggccgaggugcagaucgacugucugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12584 - RNA, 4412 nt, Artificial Sequence
  SARS-CoV-2/Wuhan/WIV05/2019__EPI_ISL_402128 spike protein mRNA gc mod (1-1211)(A890C_V1040C) Ferritin construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggaugcggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaugugacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12585 - RNA, 4412 nt, Artificial Sequence
  SARS-CoV-2/Wuhan/WIV05/2019__EPI_ISL_402128 spike protein mRNA gc mod (1-1211)(T874C_S1055C) Ferritin construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacugcucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagugcgccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12586 - RNA, 3998 nt, Artificial Sequence
  SARS-CoV-2/Wuhan/WIV05/2019__EPI_ISL_402128 spike protein mRNA gc mod (1-1211) Foldon construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12587 - RNA, 3998 nt, Artificial Sequence
  SARS-CoV-2/Wuhan/WIV05/2019__EPI_ISL_402128 spike protein mRNA gc mod (1-1211)(K986P_V987P) Foldon construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12588 - RNA, 3998 nt, Artificial Sequence
  SARS-CoV-2/Wuhan/WIV05/2019__EPI_ISL_402128 spike protein mRNA gc mod (1-1211)(K986P_V987P_T887WN_A1020W) Foldon construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggugguuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagauggucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12589 - RNA, 3998 nt, Artificial Sequence
  SARS-CoV-2/Wuhan/WIV05/2019__EPI_ISL_402128 spike protein mRNA gc mod (1-1211)(K986P_V987P_P1069F) Foldon construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauauguguucgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12590 - RNA, 3998 nt, Artificial Sequence
  SARS-CoV-2/Wuhan/WIV05/2019__EPI_ISL_402128 spike protein mRNA gc mod (1-1211)(K986P_V987P_ H1048Q_H1064N_ H1083N_H1101N) Foldon construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccagcugaugagcuucccucagucugccccucacggcgugguguuucugaacgugacauaugugcccgcucaagagaagaauuucaccaccgcuccagccaucugcaacgacggcaaagcccacuuuccuagagaaggcguguucguguccaacggcaccaacugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12591 - RNA, 3998 nt, Artificial Sequence
  SARS-CoV-2/Wuhan/WIV05/2019__EPI_ISL_402128 spike protein mRNA gc mod (1-1211)(I712C_T1077C) Foldon construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuugcgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccugugcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12592 - RNA, 3998 nt, Artificial Sequence
  SARS-CoV-2/Wuhan/WIV05/2019__EPI_ISL_402128 spike protein mRNA gc mod (1-1211)(I714C_Y1110C) Foldon construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuugccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucugugagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12593 - RNA, 3998 nt, Artificial Sequence
  SARS-CoV-2/Wuhan/WIV05/2019__EPI_ISL_402128 spike protein mRNA gc mod (1-1211)(P715C_P1069C) Foldon construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuaucugcaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugugugcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12594 - RNA, 3998 nt, Artificial Sequence
  SARS-CoV-2/Wuhan/WIV05/2019__EPI_ISL_402128 spike protein mRNA gc mod (1-1211)(G889C_L1034C) Foldon construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuugcgcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugaguguguguguggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12595 - RNA, 3998 nt, Artificial Sequence
  SARS-CoV-2/Wuhan/WIV05/2019__EPI_ISL_402128 spike protein mRNA gc mod (1-1211)(I909C_Y1047C) Foldon construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcugcggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcugucaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12596 - RNA, 3998 nt, Artificial Sequence
  SARS-CoV-2/Wuhan/WIV05/2019__EPI_ISL_402128 spike protein mRNA gc mod (1-1211)(Q965C_S1003C) Foldon construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagugccuguccuccaacuucggcgccaucagcucugugcugaacgauauccugagcagacuggacaaggucgaggccgaggugcagaucgacagacugaucacaggcagacugcagugucuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12597 - RNA, 3998 nt, Artificial Sequence
  SARS-CoV-2/Wuhan/WIV05/2019__EPI_ISL_402128 spike protein mRNA gc mod (1-1211)(F970C_G999C) Foldon construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacugcggcgccaucagcucugugcugaacgauauccugagcagacuggacaaggucgaggccgaggugcagaucgacagacugaucacauguagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12598 - RNA, 3998 nt, Artificial Sequence
  SARS-CoV-2/Wuhan/WIV05/2019__EPI_ISL_402128 spike protein mRNA gc mod (1-1211)(A972C_R995C) Foldon construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcugcaucagcucugugcugaacgauauccugagcagacuggacaaggucgaggccgaggugcagaucgacugucugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12599 - RNA, 3998 nt, Artificial Sequence
  SARS-CoV-2/Wuhan/WIV05/2019__EPI_ISL_402128 spike protein mRNA gc mod (1-1211)(A890C_V1040C) Foldon construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggaugcggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaugugacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12600 - RNA, 3998 nt, Artificial Sequence
  SARS-CoV-2/Wuhan/WIV05/2019__EPI_ISL_402128 spike protein mRNA gc mod (1-1211)(T874C_S1055C) Foldon construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacugcucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagugcgccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12601 - RNA, 4370 nt, Artificial Sequence
  SARS-CoV-2/Wuhan/WIV05/2019__EPI_ISL_402128 spike protein mRNA gc mod (1-1211) WhcAg construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12602 - RNA, 4370 nt, Artificial Sequence
  SARS-CoV-2/Wuhan/WIV05/2019__EPI_ISL_402128 spike protein mRNA gc mod (1-1211)(K986P_V987P) WhcAg construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12603 - RNA, 4370 nt, Artificial Sequence
  SARS-CoV-2/Wuhan/WIV05/2019__EPI_ISL_402128 spike protein mRNA gc mod (1-1211)(K986P_V987P_T887WN_A1020W) WhcAg construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggugguuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagauggucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12604 - RNA, 4370 nt, Artificial Sequence
  SARS-CoV-2/Wuhan/WIV05/2019__EPI_ISL_402128 spike protein mRNA gc mod (1-1211)(K986P_V987P_P1069F) WhcAg construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauauguguucgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12605 - RNA, 4370 nt, Artificial Sequence
  SARS-CoV-2/Wuhan/WIV05/2019__EPI_ISL_402128 spike protein mRNA gc mod (1-1211)(K986P_V987P_ H1048Q_H1064N_ H1083N_H1101N) WhcAg construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccagcugaugagcuucccucagucugccccucacggcgugguguuucugaacgugacauaugugcccgcucaagagaagaauuucaccaccgcuccagccaucugcaacgacggcaaagcccacuuuccuagagaaggcguguucguguccaacggcaccaacugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12606 - RNA, 4370 nt, Artificial Sequence
  SARS-CoV-2/Wuhan/WIV05/2019__EPI_ISL_402128 spike protein mRNA gc mod (1-1211)(I712C_T1077C) WhcAg construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuugcgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccugugcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12607 - RNA, 4370 nt, Artificial Sequence
  SARS-CoV-2/Wuhan/WIV05/2019__EPI_ISL_402128 spike protein mRNA gc mod (1-1211)(I714C_Y1110C) WhcAg construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuugccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucugugagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12608 - RNA, 4370 nt, Artificial Sequence
  SARS-CoV-2/Wuhan/WIV05/2019__EPI_ISL_402128 spike protein mRNA gc mod (1-1211)(P715C_P1069C) WhcAg construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuaucugcaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugugugcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12609 - RNA, 4370 nt, Artificial Sequence
  SARS-CoV-2/Wuhan/WIV05/2019__EPI_ISL_402128 spike protein mRNA gc mod (1-1211)(G889C_L1034C) WhcAg construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuugcgcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugaguguguguguggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12610 - RNA, 4370 nt, Artificial Sequence
  SARS-CoV-2/Wuhan/WIV05/2019__EPI_ISL_402128 spike protein mRNA gc mod (1-1211)(I909C_Y1047C) WhcAg construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcugcggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcugucaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12611 - RNA, 4370 nt, Artificial Sequence
  SARS-CoV-2/Wuhan/WIV05/2019__EPI_ISL_402128 spike protein mRNA gc mod (1-1211)(Q965C_S1003C) WhcAg construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagugccuguccuccaacuucggcgccaucagcucugugcugaacgauauccugagcagacuggacaaggucgaggccgaggugcagaucgacagacugaucacaggcagacugcagugucuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12612 - RNA, 4370 nt, Artificial Sequence
  SARS-CoV-2/Wuhan/WIV05/2019__EPI_ISL_402128 spike protein mRNA gc mod (1-1211)(F970C_G999C) WhcAg construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacugcggcgccaucagcucugugcugaacgauauccugagcagacuggacaaggucgaggccgaggugcagaucgacagacugaucacauguagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12613 - RNA, 4370 nt, Artificial Sequence
  SARS-CoV-2/Wuhan/WIV05/2019__EPI_ISL_402128 spike protein mRNA gc mod (1-1211)(A972C_R995C) WhcAg construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcugcaucagcucugugcugaacgauauccugagcagacuggacaaggucgaggccgaggugcagaucgacugucugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12614 - RNA, 4370 nt, Artificial Sequence
  SARS-CoV-2/Wuhan/WIV05/2019__EPI_ISL_402128 spike protein mRNA gc mod (1-1211)(A890C_V1040C) WhcAg construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggaugcggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaugugacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12615 - RNA, 4370 nt, Artificial Sequence
  SARS-CoV-2/Wuhan/WIV05/2019__EPI_ISL_402128 spike protein mRNA gc mod (1-1211)(T874C_S1055C) WhcAg construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacugcucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagugcgccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12616 - RNA, 4196 nt, Artificial Sequence
  SARS-CoV-2/Wuhan/WIV05/2019__EPI_ISL_402128 spike protein mRNA gc mod (1-1147) LumSynth construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12617 - RNA, 4196 nt, Artificial Sequence
  SARS-CoV-2/Wuhan/WIV05/2019__EPI_ISL_402128 spike protein mRNA gc mod (1-1147)(K986P_V987P) LumSynth construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12618 - RNA, 4196 nt, Artificial Sequence
  SARS-CoV-2/Wuhan/WIV05/2019__EPI_ISL_402128 spike protein mRNA gc mod (1-1147)(K986P_V987P_T887WN_A1020W) LumSynth construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggugguuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagauggucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12619 - RNA, 4196 nt, Artificial Sequence
  SARS-CoV-2/Wuhan/WIV05/2019__EPI_ISL_402128 spike protein mRNA gc mod (1-1147)(K986P_V987P_P1069F) LumSynth construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauauguguucgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12620 - RNA, 4196 nt, Artificial Sequence
  SARS-CoV-2/Wuhan/WIV05/2019__EPI_ISL_402128 spike protein mRNA gc mod (1-1147)(K986P_V987P_ H1048Q_H1064N_ H1083N_H1101N) LumSynth construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccagcugaugagcuucccucagucugccccucacggcgugguguuucugaacgugacauaugugcccgcucaagagaagaauuucaccaccgcuccagccaucugcaacgacggcaaagcccacuuuccuagagaaggcguguucguguccaacggcaccaacugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12621 - RNA, 4196 nt, Artificial Sequence
  SARS-CoV-2/Wuhan/WIV05/2019__EPI_ISL_402128 spike protein mRNA gc mod (1-1147)(I712C_T1077C) LumSynth construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuugcgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccugugcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12622 - RNA, 4196 nt, Artificial Sequence
  SARS-CoV-2/Wuhan/WIV05/2019__EPI_ISL_402128 spike protein mRNA gc mod (1-1147)(I714C_Y1110C) LumSynth construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuugccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucugugagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12623 - RNA, 4196 nt, Artificial Sequence
  SARS-CoV-2/Wuhan/WIV05/2019__EPI_ISL_402128 spike protein mRNA gc mod (1-1147)(P715C_P1069C) LumSynth construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuaucugcaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugugugcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12624 - RNA, 4196 nt, Artificial Sequence
  SARS-CoV-2/Wuhan/WIV05/2019__EPI_ISL_402128 spike protein mRNA gc mod (1-1147)(G889C_L1034C) LumSynth construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuugcgcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugaguguguguguggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12625 - RNA, 4196 nt, Artificial Sequence
  SARS-CoV-2/Wuhan/WIV05/2019__EPI_ISL_402128 spike protein mRNA gc mod (1-1147)(I909C_Y1047C) LumSynth construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcugcggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcugucaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12626 - RNA, 4196 nt, Artificial Sequence
  SARS-CoV-2/Wuhan/WIV05/2019__EPI_ISL_402128 spike protein mRNA gc mod (1-1147)(Q965C_S1003C) LumSynth construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagugccuguccuccaacuucggcgccaucagcucugugcugaacgauauccugagcagacuggacaaggucgaggccgaggugcagaucgacagacugaucacaggcagacugcagugucuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12627 - RNA, 4196 nt, Artificial Sequence
  SARS-CoV-2/Wuhan/WIV05/2019__EPI_ISL_402128 spike protein mRNA gc mod (1-1147)(F970C_G999C) LumSynth construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacugcggcgccaucagcucugugcugaacgauauccugagcagacuggacaaggucgaggccgaggugcagaucgacagacugaucacauguagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12628 - RNA, 4196 nt, Artificial Sequence
  SARS-CoV-2/Wuhan/WIV05/2019__EPI_ISL_402128 spike protein mRNA gc mod (1-1147)(A972C_R995C) LumSynth construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcugcaucagcucugugcugaacgauauccugagcagacuggacaaggucgaggccgaggugcagaucgacugucugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12629 - RNA, 4196 nt, Artificial Sequence
  SARS-CoV-2/Wuhan/WIV05/2019__EPI_ISL_402128 spike protein mRNA gc mod (1-1147)(A890C_V1040C) LumSynth construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggaugcggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaugugacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12630 - RNA, 4196 nt, Artificial Sequence
  SARS-CoV-2/Wuhan/WIV05/2019__EPI_ISL_402128 spike protein mRNA gc mod (1-1147)(T874C_S1055C) LumSynth construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacugcucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagugcgccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12631 - RNA, 4220 nt, Artificial Sequence
  SARS-CoV-2/Wuhan/WIV05/2019__EPI_ISL_402128 spike protein mRNA gc mod (1-1147) Ferritin construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12632 - RNA, 4220 nt, Artificial Sequence
  SARS-CoV-2/Wuhan/WIV05/2019__EPI_ISL_402128 spike protein mRNA gc mod (1-1147)(K986P_V987P) Ferritin construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12633 - RNA, 4220 nt, Artificial Sequence
  SARS-CoV-2/Wuhan/WIV05/2019__EPI_ISL_402128 spike protein mRNA gc mod (1-1147)(K986P_V987P_T887WN_A1020W) Ferritin construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggugguuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagauggucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12634 - RNA, 4220 nt, Artificial Sequence
  SARS-CoV-2/Wuhan/WIV05/2019__EPI_ISL_402128 spike protein mRNA gc mod (1-1147)(K986P_V987P_P1069F) Ferritin construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauauguguucgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12635 - RNA, 4220 nt, Artificial Sequence
  SARS-CoV-2/Wuhan/WIV05/2019__EPI_ISL_402128 spike protein mRNA gc mod (1-1147)(K986P_V987P_ H1048Q_H1064N_ H1083N_H1101N) Ferritin construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccagcugaugagcuucccucagucugccccucacggcgugguguuucugaacgugacauaugugcccgcucaagagaagaauuucaccaccgcuccagccaucugcaacgacggcaaagcccacuuuccuagagaaggcguguucguguccaacggcaccaacugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12636 - RNA, 4220 nt, Artificial Sequence
  SARS-CoV-2/Wuhan/WIV05/2019__EPI_ISL_402128 spike protein mRNA gc mod (1-1147)(I712C_T1077C) Ferritin construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuugcgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccugugcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12637 - RNA, 4220 nt, Artificial Sequence
  SARS-CoV-2/Wuhan/WIV05/2019__EPI_ISL_402128 spike protein mRNA gc mod (1-1147)(I714C_Y1110C) Ferritin construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuugccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucugugagccccagaucaucaccaccgacaacaccuucgugucuggcaacugcgacguugugaucggcauugugaacaauaccguguacgacccucugcagcccgagcuggacagcggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12638 - RNA, 4220 nt, Artificial Sequence
  SARS-CoV-2/Wuhan/WIV05/2019__EPI_ISL_402128 spike protein mRNA gc mod (1-1147)(P715C_P1069C) Ferritin construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuaucugcaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugugugcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12639 - RNA, 4220 nt, Artificial Sequence
  SARS-CoV-2/Wuhan/WIV05/2019__EPI_ISL_402128 spike protein mRNA gc mod (1-1147)(G889C_L1034C) Ferritin construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuugcgcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugaguguguguguggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12640 - RNA, 4220 nt, Artificial Sequence
  SARS-CoV-2/Wuhan/WIV05/2019__EPI_ISL_402128 spike protein mRNA gc mod (1-1147)(I909C_Y1047C) Ferritin construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcugcggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcugucaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12641 - RNA, 4220 nt, Artificial Sequence
  SARS-CoV-2/Wuhan/WIV05/2019__EPI_ISL_402128 spike protein mRNA gc mod (1-1147)(Q965C_S1003C) Ferritin construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagugccuguccuccaacuucggcgccaucagcucugugcugaacgauauccugagcagacuggacaaggucgaggccgaggugcagaucgacagacugaucacaggcagacugcagugucuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12642 - RNA, 4220 nt, Artificial Sequence
  SARS-CoV-2/Wuhan/WIV05/2019__EPI_ISL_402128 spike protein mRNA gc mod (1-1147)(F970C_G999C) Ferritin construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacugcggcgccaucagcucugugcugaacgauauccugagcagacuggacaaggucgaggccgaggugcagaucgacagacugaucacauguagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12643 - RNA, 4220 nt, Artificial Sequence
  SARS-CoV-2/Wuhan/WIV05/2019__EPI_ISL_402128 spike protein mRNA gc mod (1-1147)(A972C_R995C) Ferritin construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcugcaucagcucugugcugaacgauauccugagcagacuggacaaggucgaggccgaggugcagaucgacugucugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12644 - RNA, 4220 nt, Artificial Sequence
  SARS-CoV-2/Wuhan/WIV05/2019__EPI_ISL_402128 spike protein mRNA gc mod (1-1147)(A890C_V1040C) Ferritin construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggaugcggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaugugacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12645 - RNA, 4220 nt, Artificial Sequence
  SARS-CoV-2/Wuhan/WIV05/2019__EPI_ISL_402128 spike protein mRNA gc mod (1-1147)(T874C_S1055C) Ferritin construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacugcucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagugcgccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12646 - RNA, 3806 nt, Artificial Sequence
  SARS-CoV-2/Wuhan/WIV05/2019__EPI_ISL_402128 spike protein mRNA gc mod (1-1147) Foldon construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggaucuggcuauauccccgaggcuccuagagauggccaggccuauguucggaaggauggcgaaugggugcugcugagcaccuuccuuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12647 - RNA, 3806 nt, Artificial Sequence
  SARS-CoV-2/Wuhan/WIV05/2019__EPI_ISL_402128 spike protein mRNA gc mod (1-1147)(K986P_V987P) Foldon construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggaucuggcuauauccccgaggcuccuagagauggccaggccuauguucggaaggauggcgaaugggugcugcugagcaccuuccuuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12648 - RNA, 3806 nt, Artificial Sequence
  SARS-CoV-2/Wuhan/WIV05/2019__EPI_ISL_402128 spike protein mRNA gc mod (1-1147)(K986P_V987P_T887WN_A1020W) Foldon construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggugguuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagauggucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggaucuggcuauauccccgaggcuccuagagauggccaggccuauguucggaaggauggcgaaugggugcugcugagcaccuuccuuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12649 - RNA, 3806 nt, Artificial Sequence
  SARS-CoV-2/Wuhan/WIV05/2019__EPI_ISL_402128 spike protein mRNA gc mod (1-1147)(K986P_V987P_P1069F) Foldon construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauauguguucgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggaucuggcuauauccccgaggcuccuagagauggccaggccuauguucggaaggauggcgaaugggugcugcugagcaccuuccuuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12650 - RNA, 3806 nt, Artificial Sequence
  SARS-CoV-2/Wuhan/WIV05/2019__EPI_ISL_402128 spike protein mRNA gc mod (1-1147)(K986P_V987P_ H1048Q_H1064N_ H1083N_H1101N) Foldon construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccagcugaugagcuucccucagucugccccucacggcgugguguuucugaacgugacauaugugcccgcucaagagaagaauuucaccaccgcuccagccaucugcaacgacggcaaagcccacuuuccuagagaaggcguguucguguccaacggcaccaacugguucgugacacagcggaacuucuacgagccccagaucaucaccaccgacaacaccuucgugucuggcaacugcgacguugugaucggcauugugaacaauaccguguacgacccucugcagcccgagcuggacagcggaggaucuggcuauauccccgaggcuccuagagauggccaggccuauguucggaaggauggcgaaugggugcugcugagcaccuuccuuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12651 - RNA, 3806 nt, Artificial Sequence
  SARS-CoV-2/Wuhan/WIV05/2019__EPI_ISL_402128 spike protein mRNA gc mod (1-1147)(I712C_T1077C) Foldon construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuugcgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccugugcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggaucuggcuauauccccgaggcuccuagagauggccaggccuauguucggaaggauggcgaaugggugcugcugagcaccuuccuuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12652 - RNA, 3806 nt, Artificial Sequence
  SARS-CoV-2/Wuhan/WIV05/2019__EPI_ISL_402128 spike protein mRNA gc mod (1-1147)(I714C_Y1110C) Foldon construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuugccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucugugagccccagaucaucaccaccgacaacaccuucgugucuggcaacugcgacguugugaucggcauugugaacaauaccguguacgacccucugcagcccgagcuggacagcggaggaucuggcuauauccccgaggcuccuagagauggccaggccuauguucggaaggauggcgaaugggugcugcugagcaccuuccuuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12653 - RNA, 3806 nt, Artificial Sequence
  SARS-CoV-2/Wuhan/WIV05/2019__EPI_ISL_402128 spike protein mRNA gc mod (1-1147)(P715C_P1069C) Foldon construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuaucugcaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugugugcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggaucuggcuauauccccgaggcuccuagagauggccaggccuauguucggaaggauggcgaaugggugcugcugagcaccuuccuuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12654 - RNA, 3806 nt, Artificial Sequence
  SARS-CoV-2/Wuhan/WIV05/2019__EPI_ISL_402128 spike protein mRNA gc mod (1-1147)(G889C_L1034C) Foldon construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuugcgcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugaguguguguguggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggaucuggcuauauccccgaggcuccuagagauggccaggccuauguucggaaggauggcgaaugggugcugcugagcaccuuccuuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12655 - RNA, 3806 nt, Artificial Sequence
  SARS-CoV-2/Wuhan/WIV05/2019__EPI_ISL_402128 spike protein mRNA gc mod (1-1147)(I909C_Y1047C) Foldon construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcugcggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcugucaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggaucuggcuauauccccgaggcuccuagagauggccaggccuauguucggaaggauggcgaaugggugcugcugagcaccuuccuuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12656 - RNA, 3806 nt, Artificial Sequence
  SARS-CoV-2/Wuhan/WIV05/2019__EPI_ISL_402128 spike protein mRNA gc mod (1-1147)(Q965C_S1003C) Foldon construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagugccuguccuccaacuucggcgccaucagcucugugcugaacgauauccugagcagacuggacaaggucgaggccgaggugcagaucgacagacugaucacaggcagacugcagugucuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggaucuggcuauauccccgaggcuccuagagauggccaggccuauguucggaaggauggcgaaugggugcugcugagcaccuuccuuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12657 - RNA, 3806 nt, Artificial Sequence
  SARS-CoV-2/Wuhan/WIV05/2019__EPI_ISL_402128 spike protein mRNA gc mod (1-1147)(F970C_G999C) Foldon construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacugcggcgccaucagcucugugcugaacgauauccugagcagacuggacaaggucgaggccgaggugcagaucgacagacugaucacauguagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggaucuggcuauauccccgaggcuccuagagauggccaggccuauguucggaaggauggcgaaugggugcugcugagcaccuuccuuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12658 - RNA, 3806 nt, Artificial Sequence
  SARS-CoV-2/Wuhan/WIV05/2019__EPI_ISL_402128 spike protein mRNA gc mod (1-1147)(A972C_R995C) Foldon construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcugcaucagcucugugcugaacgauauccugagcagacuggacaaggucgaggccgaggugcagaucgacugucugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggaucuggcuauauccccgaggcuccuagagauggccaggccuauguucggaaggauggcgaaugggugcugcugagcaccuuccuuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12659 - RNA, 3806 nt, Artificial Sequence
  SARS-CoV-2/Wuhan/WIV05/2019__EPI_ISL_402128 spike protein mRNA gc mod (1-1147)(A890C_V1040C) Foldon construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggaugcggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaugugacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggaucuggcuauauccccgaggcuccuagagauggccaggccuauguucggaaggauggcgaaugggugcugcugagcaccuuccuuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12660 - RNA, 3806 nt, Artificial Sequence
  SARS-CoV-2/Wuhan/WIV05/2019__EPI_ISL_402128 spike protein mRNA gc mod (1-1147)(T874C_S1055C) Foldon construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacugcucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagugcgccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggaucuggcuauauccccgaggcuccuagagauggccaggccuauguucggaaggauggcgaaugggugcugcugagcaccuuccuuugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12661 - RNA, 4178 nt, Artificial Sequence
  SARS-CoV-2/Wuhan/WIV05/2019__EPI_ISL_402128 spike protein mRNA gc mod (1-1147) WhcAg construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12662 - RNA, 4178 nt, Artificial Sequence
  SARS-CoV-2/Wuhan/WIV05/2019__EPI_ISL_402128 spike protein mRNA gc mod (1-1147)(K986P_V987P) WhcAg construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12663 - RNA, 4178 nt, Artificial Sequence
  SARS-CoV-2/Wuhan/WIV05/2019__EPI_ISL_402128 spike protein mRNA gc mod (1-1147)(K986P_V987P_T887WN_A1020W) WhcAg construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggugguuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagauggucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12664 - RNA, 4178 nt, Artificial Sequence
  SARS-CoV-2/Wuhan/WIV05/2019__EPI_ISL_402128 spike protein mRNA gc mod (1-1147)(K986P_V987P_P1069F) WhcAg construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauauguguucgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12665 - RNA, 4178 nt, Artificial Sequence
  SARS-CoV-2/Wuhan/WIV05/2019__EPI_ISL_402128 spike protein mRNA gc mod (1-1147)(K986P_V987P_ H1048Q_H1064N_ H1083N_H1101N) WhcAg construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccagcugaugagcuucccucagucugccccucacggcgugguguuucugaacgugacauaugugcccgcucaagagaagaauuucaccaccgcuccagccaucugcaacgacggcaaagcccacuuuccuagagaaggcguguucguguccaacggcaccaacugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12666 - RNA, 4178 nt, Artificial Sequence
  SARS-CoV-2/Wuhan/WIV05/2019__EPI_ISL_402128 spike protein mRNA gc mod (1-1147)(I712C_T1077C) WhcAg construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuugcgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccugugcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12667 - RNA, 4178 nt, Artificial Sequence
  SARS-CoV-2/Wuhan/WIV05/2019__EPI_ISL_402128 spike protein mRNA gc mod (1-1147)(I714C_Y1110C) WhcAg construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuugccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucugugagccccagaucaucaccaccgacaacaccuucgugucuggcaacugcgacguugugaucggcauugugaacaauaccguguacgacccucugcagcccgagcuggacagcggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12668 - RNA, 4178 nt, Artificial Sequence
  SARS-CoV-2/Wuhan/WIV05/2019__EPI_ISL_402128 spike protein mRNA gc mod (1-1147)(P715C_P1069C) WhcAg construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuaucugcaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugugugcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12669 - RNA, 4178 nt, Artificial Sequence
  SARS-CoV-2/Wuhan/WIV05/2019__EPI_ISL_402128 spike protein mRNA gc mod (1-1147)(G889C_L1034C) WhcAg construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuugcgcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugaguguguguguggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12670 - RNA, 4178 nt, Artificial Sequence
  SARS-CoV-2/Wuhan/WIV05/2019__EPI_ISL_402128 spike protein mRNA gc mod (1-1147)(I909C_Y1047C) WhcAg construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcugcggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcugucaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12671 - RNA, 4178 nt, Artificial Sequence
  SARS-CoV-2/Wuhan/WIV05/2019__EPI_ISL_402128 spike protein mRNA gc mod (1-1147)(Q965C_S1003C) WhcAg construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagugccuguccuccaacuucggcgccaucagcucugugcugaacgauauccugagcagacuggacaaggucgaggccgaggugcagaucgacagacugaucacaggcagacugcagugucuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12672 - RNA, 4178 nt, Artificial Sequence
  SARS-CoV-2/Wuhan/WIV05/2019__EPI_ISL_402128 spike protein mRNA gc mod (1-1147)(F970C_G999C) WhcAg construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacugcggcgccaucagcucugugcugaacgauauccugagcagacuggacaaggucgaggccgaggugcagaucgacagacugaucacauguagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12673 - RNA, 4178 nt, Artificial Sequence
  SARS-CoV-2/Wuhan/WIV05/2019__EPI_ISL_402128 spike protein mRNA gc mod (1-1147)(A972C_R995C) WhcAg construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcugcaucagcucugugcugaacgauauccugagcagacuggacaaggucgaggccgaggugcagaucgacugucugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12674 - RNA, 4178 nt, Artificial Sequence
  SARS-CoV-2/Wuhan/WIV05/2019__EPI_ISL_402128 spike protein mRNA gc mod (1-1147)(A890C_V1040C) WhcAg construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggaugcggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaugugacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12675 - RNA, 4178 nt, Artificial Sequence
  SARS-CoV-2/Wuhan/WIV05/2019__EPI_ISL_402128 spike protein mRNA gc mod (1-1147)(T874C_S1055C) WhcAg construct
aggagagucccgcagucggcguccagcggcucugcuuguucgugugugugucguugcaggccuuauucaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacugcucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagugcgccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuagucccuguucccagagcccacuuuuuuuucuuuuuuugaaauaaaauagccugucuuucagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 12676 - RNA, 4039 nt, Artificial Sequence
  SARS-CoV-2/Wuhan/WIV05/2019__EPI_ISL_402128 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12677 - RNA, 4027 nt, Artificial Sequence
  SARS-CoV-2/bat/Yunnan/RaTG13/2013__EPI_ISL_402131 spike protein mRNA wt (1-1269)
aggagaaagcuuaccauguuuguuuuucuuguuuuauugccacuaguuucuagucaguguguuaaucuaacaacuagaacucaguuaccuccugcauacaccaacucauccacccguggugucuauuacccugacaaaguuuucagaucuucaguuuuacauuuaacucaggauuuguuuuuaccuuucuucuccaaugugaccugguuccaugcuauacauguuucagggaccaaugguauuaaaagguuugauaacccaguucugccauucaacgauggcgucuauuuugcuuccacugagaagucuaauauaauaagaggauggauuuuugguacuaccuuagauucgaagacccagucucuacuuauuguuaauaacgcuacuaauguuguuauuaaagucugugaauuucaauuuuguaaugauccauuuuuggguguuuauuaccacaaaaacaacaaaaguuggauggaaagugaguucagaguuuacucuagugcgaauaauugcacuuuugaguaugucucucagccuuuucuuauggaccuugaaggaaaacaggguaauuucaaaaaucuuagggaauucguguuuaagaauauugaugguuauuucaaaauauauucuaaacauacgccuauuaauuuagugcgugaucuucccccugguuuuucagcuuuagaaccauugguagaucugccaauagguauuaacaucacuagguuucaaacuuuacuugcuuuacauagaagcuauuugacuccuggugauucuucuucagguuggacagcuggugcugcagcuuauuauguggguuaucuucaaccaaggacuuuucuacuaaaauauaaugagaauggaaccauuacagaugcuguagacugugcacuugacccucuuucagaaacaaaguguacguuaaaauccuucacuguugaaaaaggaauuuaucaaaccucuaacuuuagaguccaaccaacagauucuauuguuagauucccaaauauuacaaacuuauguccuuuuggugaaguuuuuaacgccaccacauucgcaucaguuuaugcuuggaacagaaagagaauuagcaacuguguugcugauuacucuguccuauauaauuccacuucauuuucuaccuuuaaauguuauggagugucuccuacuaaauuaaaugaucucugcuuuacuaauguuuaugcagacucauuugugauuacaggugaugaagucagacaaauugcgccaggacaaacuggaaagauugcugacuacaauuauaaacuaccagaugauuuuacugguuguguuauagcuuggaauucuaagcauauugaugcaaaagagggcgguaauuuuaacuaucuuuaccgucucuuuagaaaagcuaaucuuaaacccuuugagagggauaucucaacugaaauuuaccaagcaggcagcaaaccuuguaauggucaaacuggucuaaauugcuacuacccacuuuauagauauggauuuuacccuacugaugguguuggucaccaaccuuauaggguaguaguacuuucuuuugaacuucuaaaugcaccagcaacuguuuguggaccuaagaagucuacuaacuugguuaaaaauaaaugugucaauuucaacuuuaaugguuuaacuggcacagguguccucacagagucuaauaaaaaguuucuaccuuuccaacaauuugguagagacauugcagacacuacugaugccguccgugauccacagacacuugagauucuugacauuacaccauguucuuuugguggugucaguguuauaacaccuggaacaaaugccucuaaccagguugcuguucuuuaucaggauguuaacugcacagaagucccuguugcuauccaugcagaccaacuuacucccacuuggcguguuuacuccacagguucuaauguuuuucaaacacgugcagguuguuuaauaggggcugaacaugucaauaacucguaugagugugacauaccuauuggugcaggaauaugcgccaguuaucagacucaaacuaauucacguaguguggccagucaaucuauuauugccuacacuaugucacuuggugcagaaaauucaguugcuuauucuaauaacucuauugccauaccuacaaauuuuacuauuagugugaccacugaaauucuaccugugucuaugacaaagacaucgguagacuguacaauguauauuuguggugauucaacugagugcagcaaccuuuuguugcaauaugguaguuuuugcacacaauuaaaucgugcuuuaacuggaauagcuguugaacaggacaaaaauacucaagaaguuuuugcucaaguuaaacaaauuuauaagacaccaccaauuaaagauuuuggugguuucaauuuuucacaaauauuaccagauccaucaaaaccaagcaagaggucauuuauugaggauuuacuuuucaauaaagugacacuugcugaugcuggcuucaucaaacaauauggugauugccuuggugauauugcugcuagggaucuuauuugugcucaaaaguucaauggccuuacuguucugccaccuuugcucacagaugaaaugaucgcucaauacacuucugcacuauuagcagguacaaucacuucugguuggacuuuuggugcaggugcugcuuuacaaauaccauuugccaugcaaauggcuuauagguuuaaugguauuggaguuacacagaauguucucuaugagaaccaaaaauugauugccaaccaguuuaauagugcuauuggcaaaauucaagacucacuuucuucuacagcaagugcacuuggaaaacuucaagauguugucaaccaaaaugcacaagcuuuaaacacgcuuguuaaacaacuuagcuccaauuuuggagcuauuucuagcguguuaaaugauauccuuucacgucucgacaaaguugaggcugaagugcagauugacagguugaucacaggcagacuucaaagcuugcagacauaugugacucaacaauuaauuagagcugcagaaaucagagcuucugccaaucuugcugcuacuaaaaugucagaguguguacucggacaaucaaaaagaguugauuuuuguggaaaaggcuaucaucuuaugucuuucccucagucagcaccucaugguguagucuucuugcaugugacauaugucccugcacaagaaaagaacuucacaacugcuccugccauuugucaugauggaaaagcacacuuuccacgugaagguguuuucguuucaaauggcacacacugguuuguuacacaaaggaauuuuuaugaaccacaaauuauuacaacagacaacacauuugucucugguagcugugauguuguaauaggaauugucaacaacacaguuuaugauccuuugcaaccagaacuugauucauucaaggaggaguuggauaaauacuuuaaaaaucauacaucaccugauguagauuuaggugacauuucuggcauuaaugcuucaguugucaauauucaaaaggaaauugaccgccucaaugagguugccaaaaaucuaaaugaaucucucaucgaucuccaagaacuuggaaaguaugaacaguauauaaaauggccaugguacauuuggcuagguuuuauagcuggcuugauugccauaauaauggucacgauuaugcuuugcuguaugaccaguugcugcaguugucucaagggcuguuguucuugcggaucuugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12678 - RNA, 4039 nt, Artificial Sequence
  SARS-CoV-2/Wuhan/HBCDC-HB-01/2019__EPI_ISL_402132 spike protein mRNA wt (1-1273)
aggagaaagcuuaccauguuuguuuuucuuguuuuauugccacuagucucuagucaguguguuaaucuuacaaccagaacucaauuacccccugcauacacuaauucuaucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12679 - RNA, 4039 nt, Artificial Sequence
  SARS-CoV-2/Guangdong/20SF028/2020__EPI_ISL_403936 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuauauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12680 - RNA, 4039 nt, Artificial Sequence
  SARS-CoV-2/Shenzhen/SZTH-001/2020__EPI_ISL_406592 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguucuaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugggccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12681 - RNA, 4039 nt, Artificial Sequence
  SARS-CoV-2/Shenzhen/SZTH-004/2020__EPI_ISL_406595 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuugggacaggaagagaaucagcaacuguguugcuuauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcaggcauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12682 - RNA, 4039 nt, Artificial Sequence
  SARS-CoV-2/France/IDF0372/2020__EPI_ISL_406596 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuuuccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12683 - RNA, 4039 nt, Artificial Sequence
  SARS-CoV-2/Australia/VIC01/2020__EPI_ISL_406844 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaagguauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12684 - RNA, 4039 nt, Artificial Sequence
  SARS-CoV-2/Germany/BavPat1/2020__EPI_ISL_406862 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12685 - RNA, 4039 nt, Artificial Sequence
  SARS-CoV-2/Wuhan/HBCDC-HB-02/2020__EPI_ISL_412978 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaauuuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12686 - RNA, 4039 nt, Artificial Sequence
  SARS-CoV-2/Australia/QLD02/2020__EPI_ISL_407896 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaacuugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12687 - RNA, 4039 nt, Artificial Sequence
  SARS-CoV-2/India/1-31/2020__EPI_ISL_413523 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauaguguuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12688 - RNA, 4039 nt, Artificial Sequence
  SARS-CoV-2/Guangdong/GD2020087-P0008/2020__EPI_ISL_413863 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagagaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12689 - RNA, 4039 nt, Artificial Sequence
  SARS-CoV-2/Sweden/01/2020__EPI_ISL_411951 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuguggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12690 - RNA, 4039 nt, Artificial Sequence
  SARS-CoV-2/Tianmen/HBCDC-HB-07/2020__EPI_ISL_412983 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggaucuuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12691 - RNA, 4039 nt, Artificial Sequence
  SARS-CoV-2/Hong Kong/case42_VM20002493/2020__EPI_ISL_414527 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuugcuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12692 - RNA, 4039 nt, Artificial Sequence
  SARS-CoV-2/USA/CruiseA-23/2020__EPI_ISL_414482 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaguaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12693 - RNA, 4039 nt, Artificial Sequence
  SARS-CoV-2/Hong Kong/case85_VM20002868/2020__EPI_ISL_414519 spike protein mRNA wt (1-1273)
aggagaaagcuuaccauguuuguuuuucuuguuuuagugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12694 - RNA, 4039 nt, Artificial Sequence
  SARS-CoV-2/England/200990660/2020__EPI_ISL_414523 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagcuagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12695 - RNA, 4039 nt, Artificial Sequence
  SARS-CoV-2/Australia/NSW09/2020__EPI_ISL_413595 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuucacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12696 - RNA, 4039 nt, Artificial Sequence
  SARS-CoV-2/Australia/NSW10/2020__EPI_ISL_413596 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcuucaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12697 - RNA, 4039 nt, Artificial Sequence
  SARS-CoV-2/Switzerland/1000477797/2020__EPI_ISL_413023 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaacauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12698 - RNA, 4039 nt, Artificial Sequence
  SARS-CoV-2/Belgium/BA-02291/2020__EPI_ISL_415159 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaggucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuaccugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuucugcagcaccugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12699 - RNA, 4039 nt, Artificial Sequence
  SARS-CoV-2/USA/WA8-UW5/2020__EPI_ISL_413486 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaauaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12700 - RNA, 4039 nt, Artificial Sequence
  SARS-CoV-2/England/20102000506/2020__EPI_ISL_415147 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauaugguuauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12701 - RNA, 4039 nt, Artificial Sequence
  SARS-CoV-2/Belgium/VAG-03013/2020__EPI_ISL_415155 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaacugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12702 - RNA, 4039 nt, Artificial Sequence
  SARS-CoV-2/Belgium/BC-03016/2020__EPI_ISL_415157 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaccugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12703 - RNA, 4039 nt, Artificial Sequence
  SARS-CoV-2/Germany/BavPat3/2020__EPI_ISL_414521 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaacaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12704 - RNA, 4039 nt, Artificial Sequence
  SARS-CoV-2/France/HF1805/2020__EPI_ISL_414628 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaguugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12705 - RNA, 4039 nt, Artificial Sequence
  SARS-CoV-2/Netherlands/ZuidHolland_9/2020__EPI_ISL_414445 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuuguguacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12706 - RNA, 4039 nt, Artificial Sequence
  SARS-CoV-2/Finland/FIN03032020A/2020__EPI_ISL_413602 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauaucuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12707 - RNA, 4039 nt, Artificial Sequence
  SARS-CoV-2/France/GE1977/2020__EPI_ISL_414632 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuuuuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12708 - RNA, 4039 nt, Artificial Sequence
  SARS-CoV-2/Finland/FIN-313/2020__EPI_ISL_414641 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuuaaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaaucuaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12709 - RNA, 4039 nt, Artificial Sequence
  SARS-CoV-2/Netherlands/ZuidHolland_2/2020__EPI_ISL_414556 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcucuugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12710 - RNA, 4039 nt, Artificial Sequence
  SARS-CoV-2/USA/WA-UW31/2020__EPI_ISL_414618 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaauggugcugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12711 - RNA, 4039 nt, Artificial Sequence
  SARS-CoV-2/South Korea/SNU01/2020__EPI_ISL_411929 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuugggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12712 - RNA, 4039 nt, Artificial Sequence
  SARS-CoV-2/China/WF0004/2020__EPI_ISL_413694 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggacggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagauuugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12713 - RNA, 4039 nt, Artificial Sequence
  SARS-CoV-2/China/WF0028/2020__EPI_ISL_413791 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagaaucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12714 - RNA, 4039 nt, Artificial Sequence
  SARS-CoV-2/2019-nCoV/USA-CruiseA-18/2020__MT159716.1 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguuaagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12715 - RNA, 4039 nt, Artificial Sequence
  SARS-CoV-2/SARS-CoV-2/Yunnan-01/human/2020/CHN__MT049951.1 spike protein mRNA wt (1-1273)
aggagaaagcuuaccauguuuguuuuucuuguuuuauugccacuagucucuagucaguguguuaaucuuacaaccagaacucaauuacccccugcaaacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12716 - RNA, 4039 nt, Artificial Sequence
  SARS-CoV-2/USA/WA-UW292/2020__EPI_ISL_418077 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccaguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12717 - RNA, 4039 nt, Artificial Sequence
  SARS-CoV-2/Iceland/192/2020__EPI_ISL_417819 spike protein mRNA wt (1-1273)
aggagaaagcuuaccauguuuguuuuuuuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12718 - RNA, 4039 nt, Artificial Sequence
  SARS-CoV-2/Belgium/ULG-6939/2020__EPI_ISL_417020 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguuguuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12719 - RNA, 4039 nt, Artificial Sequence
  SARS-CoV-2/France/HF2496/2020__EPI_ISL_418231 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauuguugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12720 - RNA, 4039 nt, Artificial Sequence
  SARS-CoV-2/USA/WA-UW291/2020__EPI_ISL_418076 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaauacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12721 - RNA, 4039 nt, Artificial Sequence
  SARS-CoV-2/Portugal/PT0034/2020__EPI_ISL_418019 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguauuaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12722 - RNA, 4039 nt, Artificial Sequence
  SARS-CoV-2/Iceland/202/2020__EPI_ISL_417750 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucccuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12723 - RNA, 4039 nt, Artificial Sequence
  SARS-CoV-2/USA/WA-UW261/2020__EPI_ISL_418046 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuuacaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12724 - RNA, 4039 nt, Artificial Sequence
  SARS-CoV-2/Portugal/PT0035/2020__EPI_ISL_418020 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauuucugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12725 - RNA, 4039 nt, Artificial Sequence
  SARS-CoV-2/USA/NY-NYUMC7/2020__EPI_ISL_418192 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuaucaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12726 - RNA, 4039 nt, Artificial Sequence
  SARS-CoV-2/Iceland/189/2020__EPI_ISL_417709 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaccaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12727 - RNA, 4039 nt, Artificial Sequence
  SARS-CoV-2/Australia/NSW56/2020__EPI_ISL_417408 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauucaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12728 - RNA, 4039 nt, Artificial Sequence
  SARS-CoV-2/Iceland/280/2020__EPI_ISL_417608 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucauacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12729 - RNA, 4039 nt, Artificial Sequence
  SARS-CoV-2/Iceland/247/2020__EPI_ISL_417575 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauugugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12730 - RNA, 4039 nt, Artificial Sequence
  SARS-CoV-2/Iceland/238/2020__EPI_ISL_417566 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagauguuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12731 - RNA, 4039 nt, Artificial Sequence
  SARS-CoV-2/Greece/16/2020__EPI_ISL_418265 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauguugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12732 - RNA, 4039 nt, Artificial Sequence
  SARS-CoV-2/Iceland/319/2020__EPI_ISL_417648 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauagaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12733 - RNA, 4039 nt, Artificial Sequence
  SARS-CoV-2/Congo/94/2020__EPI_ISL_417947 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagauauacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12734 - RNA, 4039 nt, Artificial Sequence
  SARS-CoV-2/Congo/158/2020__EPI_ISL_417950 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuuuugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12735 - RNA, 4039 nt, Artificial Sequence
  SARS-CoV-2/USA/UT-00034/2020__EPI_ISL_417977 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuacuacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12736 - RNA, 4039 nt, Artificial Sequence
  SARS-CoV-2/USA/UT-00033/2020__EPI_ISL_417976 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuugacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12737 - RNA, 4039 nt, Artificial Sequence
  SARS-CoV-2/USA/WI-13/2020__EPI_ISL_417516 spike protein mRNA wt (1-1273)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuauuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccuaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucagacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggguguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12738 - RNA, 4036 nt, Artificial Sequence
  SARS-CoV-2/India/1-27/2020__EPI_ISL_413522 spike protein mRNA wt (1-1272)
aggagaaagcuuaccauguuuguuuuucuuguuuuauugccacuagucucuagucaguguguuaaucuuacaaccagaacucaauuacccccugcauacacuaauucuuucacacgugguguuuauuacccugacaaaguuuucagauccucaguuuuacauucaacucaggacuuguucuuaccuuucuuuuccaauguuacuugguuccaugcuauacaugucucugggaccaaugguacuaagagguuugauaacccuguccuaccauuuaaugaugguguuuauuuugcuuccacugagaagucuaacauaauaagaggcuggauuuuugguacuacuuuagauucgaagacccagucccuacuuauuguuaauaacgcuacuaauguuguuauuaaagucugugaauuucaauuuuguaaugauccauuuuuggguguuuaccacaaaaacaacaaaaguuggauggaaagugaguucagaguuuauucuagugcgaauaauugcacuuuugaauaugucucucagccuuuucuuauggaccuugaaggaaaacaggguaauuucaaaaaucuuagggaauuuguguuuaagaauauugaugguuauuuuaaaauauauucuaagcacacgccuauuaauuuagugcgugaucucccucaggguuuuucggcuuuagaaccauugguagauuugccaauagguauuaacaucacuagguuucaaacuuuacuugcuuuacauagaaguuauuugacuccuggugauucuucuucagguuggacagcuggugcugcagcuuauuauguggguuaucuucaaccuaggacuuuucuauuaaaauauaaugaaaauggaaccauuacagaugcuguagacugugcacuugacccucucucagaaacaaaguguacguugaaauccuucacuguagaaaaaggaaucuaucaaacuucuaacuuuagaguccaaccaacagaaucuauuguuagauuuccuaauauuacaaacuugugcccuuuuggugaaguuuuuaacgccaccagauuugcaucuguuuaugcuuggaacaggaagagaaucagcaacuguguugcugauuauucuguccuauauaauuccgcaucauuuuccacuuuuaaguguuauggagugucuccuacuaaauuaaaugaucucugcuuuacuaaugucuaugcagauucauuuguaauuagaggugaugaagucauacaaaucgcuccagggcaaacuggaaagauugcugauuauaauuauaaauuaccagaugauuuuacaggcugcguuauagcuuggaauucuaacaaucuugauucuaagguuggugguaauuauaauuaccuguauagauuguuuaggaagucuaaucucaaaccuuuugagagagauauuucaacugaaaucuaucaggccgguagcacaccuuguaaugguguugaagguuuuaauuguuacuuuccuuuacaaucauaugguuuccaacccacuaaugguguugguuaccaaccauacagaguaguaguacuuucuuuugaacuucuacaugcaccagcaacuguuuguggaccuaaaaagucuacuaauuugguuaaaaacaaaugugucaauuucaacuucaaugguuuaacaggcacagguguucuuacugagucuaacaaaaaguuucugccuuuccaacaauuuggcagagacauugcugacacuacugaugcuguccgugauccacagacacuugagauucuugacauuacaccauguucuuuugguggugucaguguuauaacaccaggaacaaauacuucuaaccagguugcuguucuuuaucaggauguuaacugcacagaagucccuguugcuauucaugcagaucaacuuacuccuacuuggcguguuuauucuacagguucuaauguuuuucaaacacgugcaggcuguuuaauaggggcugaacaugucaacaacucauaugagugugacauacccauuggugcagguauaugcgcuaguuaucagacucagacuaauucuccucggcgggcacguaguguagcuagucaauccaucauugccuacacuaugucacuuggugcagaaaauucaguugcuuacucuaauaacucuauugccauacccacaaauuuuacuauuaguguuaccacagaaauucuaccagugucuaugaccaagacaucaguagauuguacaauguacauuuguggugauucaacugaaugcagcaaucuuuuguugcaauauggcaguuuuuguacacaauuaaaccgugcuuuaacuggaauagcuguugaacaagacaaaaacacccaagaaguuuuugcacaagucaaacaaauuuacaaaacaccaccaauuaaagauuuuggugguuuuaauuuuucacaaauauuaccagauccaucaaaaccaagcaagaggucauuuauugaagaucuacuuuucaacaaagugacacuugcagaugcuggcuucaucaaacaauauggugauugccuuggugauauugcugcuagagaccucauuugugcacaaaaguuuaacggccuuacuguuuugccaccuuugcucacagaugaaaugauugcucaauacacuucugcacuguuagcggguacaaucacuucugguuggaccuuuggugcaggugcugcauuacaaauaccauuugcuaugcaaauggcuuauagguuuaaugguauuggaguuacacagaauguucucuaugagaaccaaaaauugauugccaaccaauuuaauagugcuauuggcaaaauucaagacucacuuucuuccacagcaagugcacuuggaaaacuucaagauguggucaaccaaaaugcacaagcuuuaaacacgcuuguuaaacaacuuagcuccaauuuuggugcaauuucaaguguuuuaaaugauauccuuucacgucuugacaaaguugaggcugaagugcaaauugauagguugaucacaggcagacuucaaaguuugcagacauaugugacucaacaauuaauuagagcugcagaaaucagagcuucugcuaaucuugcugcuacuaaaaugucagaguguguacuuggacaaucaaaaagaguugauuuuuguggaaagggcuaucaucuuauguccuucccucagucagcaccucaugguguagucuucuugcaugugacuuaugucccugcacaagaaaagaacuucacaacugcuccugccauuugucaugauggaaaagcacacuuuccucgugaaggugucuuuguuucaaauggcacacacugguuuguaacacaaaggaauuuuuaugaaccacaaaucauuacuacagacaacacauuugugucugguaacugugauguuguaauaggaauugucaacaacacaguuuaugauccuuugcaaccugaauuagacucauucaaggaggaguuagauaaauauuuuaagaaucauacaucaccagauguugauuuaggugacaucucuggcauuaaugcuucaguuguaaacauucaaaaagaaauugaccgccucaaugagguugccaagaauuuaaaugaaucucucaucgaucuccaagaacuuggaaaguaugagcaguauauaaaauggccaugguacauuuggcuagguuuuauagcuggcuugauugccauaguaauggugacaauuaugcuuugcuguaugaccaguugcuguaguugucucaagggcuguuguucuuguggauccugcugcaaauuugaugaagacgacucugagccagugcucaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12739 - RNA, 4021 nt, Artificial Sequence
  SARS-CoV-2/pangolin/Guangxi/P4L/2017__EPI_ISL_410538 spike protein mRNA wt (1-1267)
aggagaaagcuuaccauguuuguuuuucuuuuugucuugccuuugguuuccagucaaugugucaauuugaccacaagaacuggaauaccgccagguuauaccaauucaucuacuagaggugucuauuauccagacaaaguuuuuaggucuucaauuuuacaucuuacacaagaccuuuucuuaccuuucuuuucuaauguuacuugguuuaacaccauaaauuaucaaggaggcuuuaagaaguuugacaauccuguuuuaccauuuaaugaugguguuuacuuugccuccacggaaaaguccaauauuauacgcgguuggauuuuuggaacaacacuugaugccagaacucaaucucuucuaauaguuaacaacgcaaccaauguuguuaucaaaguaugugaguuucaguuuugcacugauccauuuuuagguguuuacuaucauaacaacaauaaaacauggguugaaaaugaguuuagaguuuauucaagugccaacaauugcacuuucgaauacauuucucaaccuuuucuuauggaccuugaaggaaagcaagguaauuuuaagaaccuuagagaguuuguguuuaaaaauguugaugguuauuucaagauuuacucuaaacacacaccuauugauuuagugcgcgaccuccccagagguuuugcugcauuggaaccacugguggaccucccuauagguauuaauauuaccagauuccaaacauugcuugcuuuacauagaaguuaucuuacaccugguaaucuagaaaguggcuggacaacuggagcugcugcuuacuauguagguuaccuacaacagaggacuuuucucuuaaguuacaaucaaaauggaaccauuacagaugcuguugauuguucacuagacccucuuucagagacaaagugcacauuaaaaucccuaacaguugaaaaaggaauuuaccagacuucuaacuucagaguucaaccaacaaucaguauaguuagauuuccuaauauuacaaacuuauguccauuuggagaaguguuuaacgcauccaaauuugcaucaguuuaugcuuggaacaggaagagaauuagcaauuguguugcugauuacucuguacuuuauaacucuacaucauuuuccacuuuuaaauguuauggaguuucaccuacaaaacucaaugaccuuugcuucaccaauguguaugcagacucauuuguuguuaaaggugacgagguuagacaaauagcacccggacaaacugguguuauugcugauuauaacuauaagcugccagaugauuuuacugguuguguuauugcuuggaacucaguuaagcaagaugcuuugacuggugguaauuaugguuauuuguauagauuauuuagaaagucuaagcuuaaaccauuugagagagauauuuccacugaaauauaccaagccggcagcacacccuguaacggucaaguuggucuaaauuguuauuauccucuugaaagguaugguuuucacccaacuacagguguuaacuaccaaccuuuuagagugguuguuuuaucauuugaguuacuuaauggaccagcuacuguuuguggacccaaauugucuacaacacuaguuaaagacaaaugugucaauuucaacuuuaacgguuuaacuggcacagguguucuuacaacaucuaagaaacaguuucugccuuuucaacaauuugguagagacaucucugacacuacugaugcuguccgugacccacagacacuugaaauacuugacauuaccccuugcucuuuuggaggaguuagugugauaacaccagguacaaacacuucuaaucaaguggcuguacuuuaccaagauguuaacuguacugaagugccuauggccauucaugcagaacaacuuacaccugccuggcguguuuacucugcaggagcaaauguguuucaaacaagagcaggcuguuuaguaggugcugagcaugucaacaauucuuaugaaugugacauuccagucggugcuggcauaugugcaaguuaccauuccaugucaucauugcguagugucaaccagcguucaaucauugcuuacacuaugucuuuaggugcagaaaauucaguugcuuauucuaauaauucaauugccauaccuacuaauuuuacaauaaguguuaccacagaaauucuaccagugucaaugacuaagacuucuguagauuguacuauguacaucuguggagauucaauugaguguaguaauuuauugcuacaauauggcaguuuuugcacacaauuaaaccgugcuuugacugggauugcuguugaacaagacaaaaacacacaagaaguuuuugcccagguuaaacaaaucuacaaaacaccaccuauuaaagauuuugguggcuuuaacuuuucacaaauauugccagauccaucaaaaccaagcaagaggucauuuauugaggauuuacucuucaacaaagugacacuugcugaugcuggcuucaucaaacaauauggugauugccuuggugauauugcugcuagagaucucaucugugcacaaaaguucaauggacucacgguucuaccgccuuugcucacagaugaaaugauugcucaauacacuucugcacuacuugcuggaacaaucaccucagguuggaccuuuggugcaggagcugcuuuacaaauacccuuugcaaugcaaauggcuuacagguuuaauggcauuggagucacucagaauguucuauaugagaaucagaaauuaauugccaaucaguucaacagugcuauuggcaaaauacaggauucacuuucaucuacggcuagugcacuugguaaacuucaagacgucguaaaucaaaaugcacaggcuuuaaacacacuugucaaacaacuuaguuccaauuuuggagcuauuucgagugugcuuaaugauauucuuucacgucuugacaaaguugaggcugaagugcaaauugauagguuaaucacaggaagacuacagagucuucaaacuuaugugacacaacaauuaaucagagcagcagaaaucagagcuucugcuaaucuugcugcaacaaaaaugucugagugcguacucggacaaucuaaaagaguugauuuuuguggaaaaggcuaccauuuaaugucuuucccucaaucagcaccgcaugguguuguuuucuugcauguuacuuauguaccugcacaagaaaagaacuuuacuacugcuccugcuauuugucaugaaggaaaagcacacuucccucgugaaggugucuucguuucaaauggcacucauugguuuauuacacaaaggaauuuuuaugaaccucaaauuauuaccacugacaacacauucgucucugguagcugugauguuguaauuggaauagucaacaacacaguuuaugauccuuugcaacccgagcuugacucauuuaaggaggaguuagacaaauacuucaaaaaucacacaucaccagauguugaucuuggcgacauaucuggcauaaaugcuucggucgucaacauacaaaaagaaauugaccgccucaaugagguugccaaaaauuugaaugaaucacccauugaccuacaagagcuuggaaaauaugagcaauacaucaaauggccuugguacauuuggcuugguuuuauagcugggcuaauugcuaucauuauggucacaaucaugcuauguuguaugacuaguugcuguaguugccucaaggguuguugcucuugcgguuccugcugcaaauuugaugaagacgauucagaaccuguucugaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12740 - RNA, 4021 nt, Artificial Sequence
  SARS-CoV-2/pangolin/Guangxi/P5L/2017__EPI_ISL_410540 spike protein mRNA wt (1-1267)
aggagaaagcuuaccauguuuguuuuucuuuuugucuugccuuugguuuccagucaaugugucaauuugaccacaagaacuggaauaccgccagguuauaccaauucaucuacuagaggugucuauuauccagacaaaguuuuuaggucuucaauuuuacaucuuacacaagaccuuuucuuaccuuucuuuucuaauguuacuugguuuaacaccauaaauuaucaaggaggcuuuaagaaguuugacaauccuguuuuaccauuuaaugaugguguuuacuuugccuccacggaaaaguccaauauuauacgcgguuggauuuuuggaacaacacuugaugccagaacucaaucucuucuaauaguuaacaacgcaaccaauguuguuaucaaaguaugugaguuucaguuuugcacugauccauuuuuagguguuuacuaucauaacaacaauaaaacauggguugaaaaugaguuuagaguuuauucaagugccaacaauugcacuuucgaauacauuucucaaccuuuucuuauggaccuugaaggaaagcaagguaauuuuaagaaccuuagagaguuuguguuuaaaaauguugaugguuauuucaagauuuacucuaaacacacaccuauugauuuagugcgcgaccuccccagagguuuugcugcauuggaaccacugguggaccucccuauagguauuaauauuaccagauuccaaacauugcuugcuuuacauagaaguuaucuuacaccugguaagcuagaaaguggcuggacaacuggagcugcugcuuacuauguagguuaccuacaacagaggacuuuucucuuaaguuacaaucaaaauggaaccauuacagaugcuguugauuguucacuagacccucuuucagagacaaagugcacauuaaaaucccuaacaguugaaaaaggaauuuaccagacuucuaacuucagaguucaaccaacaaucaguauaguuagauuuccuaauauuacaaacuuauguccauuuggagaaguguuuaacgcauccaaauuugcaucaguuuaugcuuggaacaggaagagaauuagcaauuguguugcugauuacucuguacuuuauaacucuacaucauuuuccacuuuuaaauguuauggaguuucaccuacaaaacucaaugaccuuugcuucaccaauguguaugcagacucauuuguuguuaaaggugacgagguuagacaaauagcacccggacaaacugguguuauugcugauuauaacuauaagcugccagaugauuuuacugguuguguuauugcuuggaacucaguuaagcaagaugcuuugacuggugguaauuaugguuauuuguauagauuauuuagaaagucuaagcuuaaaccauuugagagagauauuuccacugaaauauaccaagccggcagcacacccuguaacggucaaguuggucuaaauuguuauuauccucuugaaagguaugguuuucacccaacuacagguguuaacuaccaaccuuuuagagugguuguuuuaucauuugaguuacuuaauggaccagcuacuguuuguggacccaaauugucuacaacacuaguuaaagacaaaugugucaauuucaacuuuaacgguuuaacuggcacagguguucuuacaacaucuaagaaacaguuucugccuuuucaacaauuugguagagacaucucugacacuacugaugcuguccgugacccacagacacuugaaauacuugacauuaccccuugcucuuuuggaggaguuagugugauaacaccagguacaaacacuucuaaucaaguggcuguacuuuaccaagauguuaacuguacugaagugccuauggccauucaugcagaacaacuuacaccugccuggcguguuuacucugcaggagcaaauguguuucaaacaagagcaggcuguuuaguaggugcugagcaugucaacaauucuuaugaaugugacauuccagucggugcuggcauaugugcaaguuaccauuccaugucaucauuucguagugucaaccagcguucaaucauugcuuacacuaugucuuuaggugcagaaaauucaguugcuuauucuaauaauucaauugccauaccuacuaauuuuacaauaaguguuaccacagaaauucuaccagugucaaugacuaagacuucuguagauuguacuauguacaucuguggagauucaauugaguguaguaauuuauugcuacaauauggcaguuuuugcacacaauuaaaccgugcuuugacugggauugcuguugaacaagacaaaaacacacaagaaguuuuugcccagguuaaacaaaucuacaaaacaccaccuauuaaagauuuugguggcuuuaacuuuucacaaauauugccagauccaucaaaaccaagcaagaggucauuuauugaggauuuacucuucaacaaagugacacuugcugaugcuggcuucaucaaacaauauggugauugccuuggugauauugcugcuagagaucucaucugugcacaaaaguucaauggacucacgguucuaccgccuuugcucacagaugaaaugauugcucaauacacuucugcacuacuugcuggaacaaucaccucagguuggaccuuuggugcaggagcugcuuuacaaauacccuuugcaaugcaaauggcuuacagguuuaauggcauuggagucacucagaauguucuauaugagaaucagaaauuaauugccaaucaguucaacagugcuauuggcaaaauacaggauucacuuucaucuacggcuagugcacuugguaaacuucaagacgucguaaaucaaaaugcacaggcuuuaaacacacuugucaaacaacuuaguuccaauuuuggagcuauuucgagugugcuuaaugauauucuuucacgucuugacaaaguugaggcugaagugcaaauugauagguuaaucacaggaagacuacagagucuucaaacuuaugugacacaacaauuaaucagagcagcagaaaucagagcuucugcuaaucuugcugcaacaaaaaugucugagugcguacucggacaaucuaaaagaguugauuuuuguggaaaaggcuaccauuuaaugucuuucccucaaucagcaccgcaugguguuguuuucuugcauguuacuuauguaccugcacaagaaaagaacuuuacuacugcuccugcuauuugucaugaaggaaaagcacacuucccucgugaaggugucuucguuucaaauggcacucauugguuuauuacacaaaggaauuuuuaugaaccucaaauuauuaccacugacaacacauucgucucugguagcugugauguuguaauuggaauagucaacaacacaguuuaugauccuuugcaacccgagcuugacucauuuaaggaggaguuagacaaauacuucaaaaaucacacaucaccagauguugaucuuggcgacauaucuggcauaaaugcuucggucgucaacauacaaaaagaaauugaccgccucaaugagguugccaaaaauuugaaugaaucacucauugaccuacaagagcuuggaaaauaugagcaauacaucaaauggccuugguacauuuggcuugguuuuauagcugggcuaauugcuaucauuauggucacaaucaugcuauguuguaugacuaguugcuguaguugccucaaggguuguugcucuugcgguuccugcugcaaauuugaugaagacgauucagaaccuguucugaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12741 - RNA, 4021 nt, Artificial Sequence
  SARS-CoV-2/pangolin/Guangxi/P5E/2017__EPI_ISL_410541 spike protein mRNA wt (1-1267)
aggagaaagcuuaccauguuuguuuuucuuuuugucuugccuuugguuuccagucaaugugucaauuugaccacaagaacuggaauaccgccagguuauaccaauucaucuacuagaggugucuauuauccagacaaaguuuuuaggucuucaauuuuacaucuuacacaagaccuuuucuuaccuuucuuuucuaauguuacuugguuuaacaccauaacuuaucaaggaggcucuaagaaguuugacaauccuguuuuaccauuuaaugaugguguuuacuuugccuccacggaaaaguccaauauuauacgcgguuggauuuuuggaacaacacuugaugccagaacucaaucucuucuaauaguuaacaacgcaaccaauguuguuaucaaaguaugugaguuucaguuuugcacugauccauuuuuagguguuuacuaucauaacaacaauaaaacauggguugaaaaugaguuuagaguuuauucaagugccaacaauugcacuuucgaauacauuucucaaccuuuucuuauggaccuugaaggaaagcaagguaauuuuaagaaccuuagagaguuuguguuuaaaaauguugaugguuauuucaagauuuacucuaaacacacaccuauugauuuagugcgcgaccuccccagagguuuugcugcauuggaaccacugguggaccucccuauagguauuaauauuaccagauuccaaacauugcuugcuuuacauagaaguuaucuuacaccugguaagcuagaaaguggcuggacaacuggagcugcugcuuacuauguagguuaccuacaacagaggacuuuucucuuaaguuacaaucaaaauggaaccauuacagaugcuguugauuguucacuagacccucuuucagagacaaagugcacauuaaaaucccuaacaguugaaaaaggaauuuaccagacuucuaacuucagaguucaaccaacaaucaguauaguuagauuuccuaauauuacaaacuuauguccauuuggagaaguguuuaacgcauccaaauuugcaucaguuuaugcuuggaacaggaagagaauuagcaauuguguugcugauuacucuguacuuuauaacucuacaucauuuuccacuuuuaaauguuauggaguuucaccuacaaaacucaaugaccuuugcuucaccaauguguaugcagacucauuuguuguuaaaggugacgagguuagacaaauagcacccggacaaacugguguuauugcugauuauaacuauaagcugccagaugauuuuacugguuguguuauugcuuggaacucaguuaagcaagaugcuuugacuggugauaauuaugguuauuuguauagauuauuuagaaagucuaagcuuaaaccauuugagagagauauuuccacugaaauauaccaagccggcagcacacccuguaacggucaaguuggucuaaauuguuauuauccucuugaaagguaugguuuucacccaacuacagguguuaacuaccaaccuuuuagagugguuguuuuaucauuugaguuacuuaauggaccagcuacuguuuguggacccaaauugucuacaacacuaguuaaagacaaaugugucaauuucaacuuuaacgguuuaacuggcacagguguucuuacaacaucuaagaaacaguuucugccuuuucaacaauuugguagagacaucucugacacuacugaugcuguccgugacccacagacacuugaaauacuugacauuaccccuugcucuuuuggaggaguuagugugauaacaccagguacaaacacuucuaaucaaguggcuguacuuuaccaagauguuaacuguacugaagugccuauggccauucaugcagaacaacuuacaccugccuggcguguuuacucugcaggagcaaauguguuucaaacaagagcaggcuguuuaguaggugcugagcaugucaacaauucuuaugaaugugacauuccagucggugcuggcauaugugcaaguuaccauuccaugucaucauuucguagugucaaccagcguucaaucauugcuuacacuaugucuuuaggugcagaaaauucaguugcuuauucuaauaauucaauugccauaccuacuaauuuuacaauaaguguuaccacagaaauucuaccagugucaaugacuaagacuucuguagauuguacuauguacaucuguggagauucaauugaguguaguaauuuauugcuacaauauggcaguuuuugcacacaauuaaaccgugcuuugacugggauugcuguugaacaagacaaaaacacacaagaaguuuuugcccagguuaaacaaaucuacaaaacaccaccuauuaaagauuuugguggcuuuaacuuuucacaaauauugccagauccaucaaaaccaagcaagaggucauuuauugaggauuuacucuucaacaaagugacacuugcugaugcuggcuucaucaaacaauauggugauugccuuggugauauugcugcuagagaucucaucugugcacaaaaguucaauggacucacgguucuaccgccuuugcucacagaugaaaugauugcucaauacacuucugcacuacuugcuggaacaaucaccucagguuggaccuuuggugcaggagcugcuuuacaaauacccuuugcaaugcaaauggcuuacagguuuaauggcauuggagucacucagaauguucuauaugagaaucagaaauuaauugccaaucaguucaacagugcuauuggcaaaauacaggauucacuuucaucuacggcuagugcacuugguaaacuucaagacgucguaaaucaaaaugcacaggcuuuaaacacacuugucaaacaacuuaguuccaauuuuggagcuauuucgagugugcuuaaugauauucuuucacgucuugacaaaguugaggcugaagugcaaauugauagguuaaucacaggaagacuacagagucuucaaacuuaugugacacaacaauuaaucagagcagcagaaaucagagcuucugcuaaucuugcugcaacaaaaaugucugagugcguacucggacaaucuaaaagaguugauuuuuguggaaaaggcuaccauuuaaugucuuucccucaaucagcaccgcaugguguuguuuucuugcauguuacuuauguaccugcacaagaaaagaacuuuacuacugcuccugcuauuugucaugaaggaaaagcacacuucccucgugaaggugucuucguuucaaauggcacucauugguuuauuacacaaaggaauuuuuaugaaccucaaauuauuaccacugacaacacauucgucucugguagcugugauguuguaauuggaauagucaacaacacaguuuaugauccuuugcaacccgagcuugacucauuuaaggaggaguuagacaaauacuucaaaaaucacacaucaccagauguugaucuuggcgacauaucuggcauaaaugcuucggucgucaacauacaaaaagaaauugaccgccucaaugagguugccaaaaauuugaaugaaucacucauugaccuacaagagcuuggaaaauaugagcaauacaucaaauggccuugguacauuuggcuugguuuuauagcugggcuaauugcuaucauuauggucacaaucaugcuauguuguaugacuaguugcuguaguugccucaaggguuguugcucuugcgguuccugcugcaaauuugaugaagacgauucagaaccuguucugaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12742 - RNA, 4015 nt, Artificial Sequence
  SARS-CoV-2/pangolin/Guangxi/P1E/2017__EPI_ISL_410539 spike protein mRNA wt (1-1265)
aggagaaagcuuaccauguuuguuuuucuuuuugucuugccuuugguuuccagucaaugugucaauuugaccacaagaacuggaauacagccagguuauaccaauucaucuacuagaggugucuauuauccagacaaaguuuuuaggucuucaauuuuacaucuuacacaagaccuuuucuuaccuuucuuuucuaauguuacuugguuuaacaccauaaauuaucaaggaggcuuuaagaaguuugacaauccuguuuuaccauuuaaugaugguguuuacuuugccuccacggaaaaguccaauauuauacgcgguuggauuuuuggaacaacacuugaugccagaacucaaucucuucuaauaguuaacaacgcaaccaauguuguuaucaaaguaugugaguuucaguuuugcacugauccauuuuuagguguuuacuaucauaacaacaauaaaacauggguugaaaaugaguuuagaguuuauucaagugccaacaauugcacuuucgaauacauuucucaaccuuuucuuauggaccuugaaggaaagcaagguaauuuuaagaaccuuagagaguuuguguuuaaaaauguugaugguuauuucaagauuuacucuaaacacacaccuauugauuuagugcgcgaccuccccagagguuuugcugcauuggaaccacugguggaccucccuauagguauuaauauuaccagauuccaaacauugcuugcuuuacauagaaguuaucuuacaccugguaagcuagaaaguggcuggacaacuggagcugcugcuuacuauguagguuaccuacaacagaggacuuuucucuuaaguuacaaucaaaauggaaccauuacagaugcuguugauuguucacuagacccucuuucagagacaaagugcacauuaaaaucccuaacaguugaaaaaggaauuuaccagacuucuaacuucagaguucaaccaacaaucaguauaguuagauuuccuaauauuacaaacuuauguccauuuggagaaguguuuaacgcauccaaauuugcaucaguuuaugcuuggaacaggaagagaauuagcaauuguguugcugauuacucuguacuuuauaacucuacaucauuuuccacuuuuaaauguuauggaguuucaccuacaaaacucaaugaccuuugcuucaccaauguguaugcagacucauuuguuguuaaaggugacgagguuagacaaauagcacccggacaaacugguguuauugcugauuauaacuauaagcugccagaugauuuuacugguuguguuauugcuuggaacucaguuaagcaagaugcuuugacuggugguaauuauuuguauagauuauuuagaaagucuaagcuuaaaccauuugagagagauauuuccacugaaauauaccaagccggcagcacacccuguaacggucaaguuggucuaaauuguuauuauccucuugaaagguaugguuuucacccaacuacagguguuaacuaccaaccuuuuagagugguuguuuuaucauuugaguuacuuaauggaccagcuacuguuuguggacccaaauugucuacaacacuaguuaaagacaaaugugucaauuucaacuuuaacgguuuaacuggcacagguguucuuacaacaucuaagaaacaguuucugccuuuucaacaauuugguagagacaucucugacacuacugaugcuguccgugacccacagacacuugaaauacuugacauuaccccuugcucuuuuggaggaguuagugugauaacaccagguacaaacacuucuaaucaaguggcuguacuuuaccaagauguuaacuguacugaagugccuauggccauucaugcagaacaacuuacaccugccuggcguguuuacucugcaggagcaaauguguuucaaacaagagcaggcuguuuaguaggugcugagcaugucaacaauucuuaugaaugugacauuccagucggugcuggcauaugugcaaguuaccauuccaugucaucauugcguagugucaaccagcguucaaucauugcuuacacuaugucuuuaggugcagaaaauucaguugcuuauucuaauaauucaauugccauaccuacuaauuuuacaauaaguguuaccacagaaauucuaccagugucaaugacuaagacuucuguagauuguacuauguacaucuguggagauucaauugaguguaguaauuuauugcuacaauauggcaguuuuugcacacaauuaaaccgugcuuugacugggauugcuguugaacaagacaaaaacacacaagaaguuuuugcccagguuaaacaaaucuacaaaacaccaccuauuaaagauuuugguggcuuuaacuuuucacaaauauugccagauccaucaaaaccaagcaagaggucauuuauugaggauuuacucuucaacaaagugacacuugcugaugcuggcuucaucaaacaauauggugauugccuuggugauauugcugcuagagaucucaucugugcacaaaaguucaauggacucacgguucuaccgccuuugcucacagaugaaaugauugcucaauacacuucugcacuacuugcuggaacaaucaccucagguuggaccuuuggugcaggagcugcuuuacaaauacccuuugcaaugcaaauggcuuacagguuuaauggcauuggagucacucagaauguucuauaugagaaucagaaauuaauugccaaucaguucaacagugcuauuggcaaaauacaggauucacuuucaucuacggcuagugcacuugguaaacuucaagacgucguaaaucaaaaugcacaggcuuuaaacacacuugucaaacaacuuaguuccaauuuuggagcuauuucgagugugcuuaaugauauucuuucacgucuugacaaaguugaggcugaagugcaaauugauagguuaaucacaggaagacuacagagucuucaaacuuaugugacacaacaauuaaucagagcagcagaaaucagagcuucugcuaaucuugcugcaacaaaaaugucugagugcguacucggacaaucuaaaagaguugauuuuuguggaaaaggcuaccauuuaaugucuuucccucaaucagcaccgcaugguguuguuuucuugcauguuacuuauguaccugcacaagaaaagaacuuuacuacugcuccugcuauuugucaugaaggaaaagcacacuucccucgugaaggugucuucguuucaaauggcacucauugguuuauuacacaaaggaauuuuuaugaaccucaaauuauuaccacugacaacacauucgucucugguagcugugauguuguaauuggaauagucaacaacacaguuuaugauccuuugcaacccgagcuugacucauuuaaggaggaguuagacaaauacuucaaaaaucacacaucaccagauguugaucuuggcgacauaucuggcauaaaugcuucggucgucaacauacaaaaagaaauugaccgccucaaugagguugccaaaaauuugaaugaaucacucauugaccuacaagagcuuggaaaauaugagcaauacaucaaauggccuugguacauuuggcuugguuuuauagcugggcuaauugcuaucauuauggucacaaucaugcuauguuguaugacuaguugcuguaguugccucaaggguuguugcucuugcgguuccugcugcaaauuugaugaagacgauucagaaccuguucugaaaggagucaaauuacauuacacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12743 - RNA, 4039 nt, Artificial Sequence; identical to SEQ ID NO: 162
  SARS-CoV-2/Wuhan/WIV05/2019__EPI_ISL_402128 spike protein mRNA gc (1-1273) R9514

SEQ ID NO: 12744 - RNA, 4027 nt, Artificial Sequence
  SARS-CoV-2/bat/Yunnan/RaTG13/2013__EPI_ISL_402131 spike protein mRNA gc (1-1269)
aggagaaagcuuaccauguucguguuccugguccuccugccccuggugagcucccagugcgugaaccucaccacccgcacgcagcugccgcccgccuacaccaacagcuccacccggggcgucuacuaccccgacaagguguuccgcagcuccgugcugcaccucacccaggaccuguuccugcccuucuucagcaacgucacgugguuccacgccauccacguguccgggaccaacggcaucaagcgguucgacaacccggugcuccccuucaacgacggggucuacuucgcgagcaccgagaaguccaacaucauccgcggcuggaucuucgggaccacgcuggacagcaagacccagucccugcucaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcaccuucgaguacgugagccagcccuuccugauggaccucgagggcaagcaggggaacuucaagaaccugcgcgaguucguguucaagaacaucgacggcuacuucaagaucuacuccaagcacacgccgaucaaccugguccgggaccucccgcccggguucagcgcccuggagccccugguggaccuccccaucggcaucaacaucacccgcuuccagacccugcuggcccuccaccgguccuaccugacccccggggacagcagcuccggcuggacggcgggcgccgccgccuacuacgugggguaccugcagccccgcaccuuccuccugaaguacaacgagaacggcaccaucaccgacgcggucgacugcgcccuggacccccucagcgagacgaagugcacccugaaguccuucaccguggagaaggggaucuaccagaccagcaacuuccgggugcagccgacggacuccaucguccgcuuccccaacaucaccaaccugugccccuucggcgagguguucaacgccaccaccuucgccagcgucuacgccuggaaccggaagcgcaucuccaacugcguggcggacuacagcgugcucuacaacuccacgagcuucuccaccuucaagugcuacggcgucagccccaccaagcugaacgaccugugcuucaccaacguguacgccgacuccuucgugaucacgggggacgagguccggcagaucgccccgggccagaccgggaagaucgccgacuacaacuacaagcuccccgacgacuucaccggcugcgugaucgccuggaacagcaagcacaucgacgcgaaggagggcgggaacuucaacuaccuguaccgccuguuccggaaggccaaccucaagcccuucgagcgcgacaucuccaccgagaucuaccaggccggcagcaagcccugcaacgggcagacgggccugaacugcuacuacccgcuguaccgguacggguucuaccccaccgacggcguggggcaccagcccuaccgcgucguggugcucuccuucgagcugcugaacgcccccgccaccgucugcggcccgaagaaguccaccaaccucgugaagaacaagugcgugaacuucaacuucaacggccugaccgggacgggcguccugaccgagagcaacaagaaguuccugcccuuccagcaguucgggcgggacaucgcggacaccaccgacgccgugcgcgacccccagacgcucgagauccuggacaucaccccgugcagcuucggcggggugagcgucaucacccccggcaccaacgccuccaaccagguggccgugcuguaccaggacgucaacugcacggaggugcccguggccauccacgcggaccagcucacccccaccuggcgcgucuacagcaccggcuccaacguguuccagacgcgggccgggugccugaucggcgccgagcacgugaacaacagcuacgagugcgacaucccgaucggggccggcaucugcgcguccuaccagacccagaccaacagccgcuccgucgccagccaguccaucaucgccuacaccaugagccugggcgccgagaacuccguggccuacagcaacaacuccaucgcgauccccacgaacuucaccaucagcgugaccaccgagauccuccccgucuccaugacgaagaccagcguggacugcaccauguacaucugcggggacuccaccgagugcagcaaccugcugcuccaguacggcagcuucugcacgcagcugaaccgggcccugaccgggaucgccguggagcaggacaagaacacccaggaggucuucgcccaggugaagcagaucuacaagacgcccccgaucaaggacuucggcggguucaacuucucccagauccuccccgaccccagcaagcccuccaagcgcagcuucaucgaggaccugcuguucaacaaggugacccucgccgacgcgggcuucaucaagcaguacggcgacugccugggggacaucgccgcccgggaccugaucugcgcccagaaguucaacggccucaccguccugccgccccugcucaccgacgagaugaucgcccaguacaccuccgcgcugcuggccgggacgaucaccagcggcuggaccuucggggccggcgccgcgcuccagauccccuucgccaugcagauggccuaccgcuucaacggcaucggggugacccagaacgugcuguacgagaaccagaagcugaucgccaaccaguucaacuccgccaucggcaagauccaggacagccucuccagcacggcguccgcccuggggaagcugcaggacgucgugaaccagaacgcccaggcccucaacacccuggugaagcagcugagcuccaacuucggcgccaucagcuccguccucaacgacauccugagccggcuggacaagguggaggcggaggugcagaucgaccgccucaucaccgggcggcugcagucccugcagaccuacgucacccagcagcucauccgcgccgccgagauccgggccagcgccaaccuggcggccacgaagauguccgagugcgugcugggccagagcaagcgcguggacuucugcggcaagggguaccaccucaugagcuucccccaguccgccccgcacggcgucguguuccugcacgugaccuacguccccgcccaggagaagaacuucaccaccgcgcccgccaucugccacgacgggaaggcccacuucccccgggagggcguguucgucagcaacgggacgcacugguucgugacccagcgcaacuucuacgagccgcagaucaucaccaccgacaacacguucguguccggcagcugcgacgucgugaucggcaucgugaacaacaccgucuacgacccccugcagcccgagcucgacuccuucaaggaggagcuggacaaguacuucaagaaccacaccagccccgacguggaccugggggacaucuccggcaucaacgccagcguggucaacauccagaaggagaucgaccggcucaacgagguggccaagaaccugaacgagucccugaucgaccuccaggagcuggggaaguacgagcaguacaucaaguggccgugguacaucuggcugggcuucaucgcgggccucaucgccaucaucauggugaccaucaugcugugcugcaugacgagcugcugcuccugccugaaggggugcugcagcugcggcuccugcugcaaguucgacgaggacgacagcgagcccguccucaagggggugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12745 - RNA, 4039 nt, Artificial Sequence
  SARS-CoV-2/Wuhan/HBCDC-HB-01/2019__EPI_ISL_402132 spike protein mRNA gc (1-1273)
aggagaaagcuuaccauguucguguuccugguccuccugccccuggugagcucccagugcgugaaccucaccacccgcacgcagcugccgcccgccuacaccaacagcaucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12746 - RNA, 4039 nt, Artificial Sequence
  SARS-CoV-2/Guangdong/20SF028/2020__EPI_ISL_403936 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcuguacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12747 - RNA, 4039 nt, Artificial Sequence
  SARS-CoV-2/Shenzhen/SZTH-001/2020__EPI_ISL_406592 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacgugcugaucggcaucgucaacaacacgguguacgacccccugcagcccgagcucgacuccuucaaggaggagcuggacaaguacuucaagaaccacaccagccccgacguggaccugggggacaucuccggcaucaacgccagcgucgugaacauccagaaggagaucgaccgccucaacgagguggccaagaaccugaacgagucccugaucgaccuccaggagcuggggaaguacgagcaguacaucaaguggccgugguacaucuggcugggcuucaucgccggccucaucgcgaucgucauggugaccaucaugcugugcugcaugaccagcugcugcuccugccugaaggggugcugcagcugcggcuccugcugcaaguucgacgaggacgacagcgggcccgugcucaagggcgucaagcugcacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12748 - RNA, 4039 nt, Artificial Sequence
  SARS-CoV-2/Shenzhen/SZTH-004/2020__EPI_ISL_406595 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccugggaccgcaagcggaucuccaacugcguggcguacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12749 - RNA, 4039 nt, Artificial Sequence
  SARS-CoV-2/France/IDF0372/2020__EPI_ISL_406596 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcuuccuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccaggacgugaacugcaccgaggugcccgucgccauccacgccgaccagcugacgcccaccuggcggguguacuccaccggcagcaacguguuccagacccgcgccgggugccucaucggcgcggagcacgucaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcguggccuacuccaacaacagcaucgccauccccaccaacuucacgaucuccgucaccaccgagauccugcccgugagcaugaccaagacgagcguggacugcaccauguacaucugcggggacuccaccgagugcagcaaccuccugcugcaguacggcuccuucugcacccagcucaaccgcgcgcugacggggaucgccgucgagcaggacaagaacacccaggagguguucgcccaggugaagcagaucuacaagacgcccccgaucaaggacuucggcggguucaacuucagccagauccugcccgaccccuccaagcccagcaagcgguccuucaucgaggaccuccuguucaacaaggucacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggugacccagaacguccucuacgagaaccagaagcugaucgccaaccaguucaacagcgccaucggcaagauccaggacucccugagcuccaccgccagcgcgcucgggaagcugcaggacguggugaaccagaacgcccaggcccugaacacgcucgucaagcagcuguccagcaacuucggcgccaucuccagcgugcugaacgacauccucucccgccuggacaagguggaggccgagguccagaucgaccggcugaucaccgggcgccuccagagccugcagaccuacgugacccagcagcugauccgggcggccgagauccgcgccagcgccaaccucgccgcgaccaagauguccgagugcgugcugggccagagcaagcgggucgacuucugcggcaagggguaccaccugauguccuucccccagagcgccccgcacggcgugguguuccuccacgucacguacgugcccgcccaggagaagaacuucaccaccgcccccgcgaucugccacgacgggaaggcccacuucccccgcgagggcgucuucguguccaacgggacccacugguucgugacgcagcggaacuucuacgagccgcagaucaucaccaccgacaacaccuucgucagcggcaacugcgacguggugaucggcaucgucaacaacacgguguacgacccccugcagcccgagcuggacuccuucaaggaggagcucgacaaguacuucaagaaccacaccagccccgacguggaccugggggacaucuccggcaucaacgccagcgucgugaacauccagaaggagaucgaccgccugaacgagguggccaagaaccucaacgagucccugaucgaccugcaggagcucgggaaguacgagcaguacaucaaguggccgugguacaucuggcugggcuucaucgccggccugaucgcgaucgucauggugaccaucaugcucugcugcaugaccagcugcugcuccugccugaaggggugcugcagcugcggcuccugcugcaaguucgacgaggacgacagcgagcccgugcugaagggggucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12750 - RNA, 4039 nt, Artificial Sequence
  SARS-CoV-2/Australia/VIC01/2020__EPI_ISL_406844 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccggcgcuaccucacgccgggggacuccagcagcggcuggaccgcgggcgccgccgccuacuacgugggguaccugcagccccggaccuuccugcucaaguacaacgagaacggcaccaucacggacgcggucgacugcgcccuggacccccuguccgagaccaagugcacccucaagagcuucaccguggagaaggggaucuaccagacguccaacuuccgcgugcagcccaccgagagcaucguccgguucccgaacaucaccaaccugugccccuucggcgagguguucaacgccacccgcuucgccuccgucuacgccuggaaccggaagcgcaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccuguaccggcuguuccgcaaguccaaccucaagcccuucgagcgggacaucagcaccgagaucuaccaggccggcuccacccccugcaacgggguggagggcuucaacugcuacuucccccugcagagcuacggguuccagccgaccaacggcgugggguaccagcccuaccgcguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgggacccccagacccuggagauccucgacaucacccccugcagcuucggcggggugagcgugaucacgccgggcaccaacaccuccaaccaggucgccgugcuguaccaggacgugaacugcaccgagguccccguggccauccacgccgaccagcugacgcccaccuggcgcguguacagcaccggcuccaacgucuuccagacccgggccgggugccucaucggcgcggagcacgugaacaacagcuacgagugcgacauccccaucggggccggcaucugcgccuccuaccagacgcagaccaacagcccgcgccgggcccgcuccguggcgagccaguccaucaucgccuacaccaugagccugggcgccgagaacuccgucgccuacagcaacaacuccaucgccauccccaccaacuucacgaucagcgugaccaccgagauccugcccguguccaugaccaagacgagcgucgacugcaccauguacaucugcggggacagcaccgagugcuccaaccuccugcugcaguacggcagcuucugcacccagcucaaccgggcgcugacggggaucgccguggagcaggacaagaacacccaggagguguucgcccaggucaagcagaucuacaagacgcccccgaucaaggacuucggcggguucaacuucucccagauccugcccgaccccagcaagcccuccaagcgcagcuucaucgaggaccuccuguucaacaaggugacccuggccgacgccggcuucaucaagcaguacggcgacugccucggggacaucgcggcccgggaccugaucugcgcccagaaguucaacggccugaccgugcucccgccccugcugaccgacgagaugaucgcccaguacaccuccgcccuccuggcggggaccaucacgagcggcuggaccuucggggccggcgccgcccugcagauccccuucgcgaugcagauggccuaccgcuucaacggcaucggggucacccagaacgugcucuacgagaaccagaagcugaucgccaaccaguucaacuccgccaucggcaagauccaggacagccuguccagcaccgccuccgcgcucgggaagcugcaggacguggucaaccagaacgcccaggcccugaacacgcucgugaagcagcugagcuccaacuucggcgccaucagcuccgugcugaacgacauccucagccggcuggacaaggucgaggccgaggugcagaucgaccgccugaucaccgggcggcuccagucccugcagaccuacgugacccagcagcugauccgcgcggccgagauccgggccagcgccaaccucgccgcgaccaagaugagcgagugcguccugggccaguccaagcgcguggacuucugcggcaagggguaccaccugaugagcuucccccaguccgccccgcacggcguggucuuccuccacgugacguacguccccgcccaggagaagaacuucaccaccgcccccgcgaucugccacgacgggaaggcccacuucccccgggagggcguguucgugagcaacgggacccacugguucgucacgcagcgcaacuucuacgagccgcagaucaucaccaccgacaacaccuucguguccggcaacugcgacguggucaucggcaucgugaacaacacgguguacgacccccugcagcccgagcuggacagcuucaaggaggagcucgacaaguacuucaagaaccacaccucccccgacgucgaccugggggacaucagcggcaucaacgccuccguggugaacauccagaaggagaucgaccggcugaacgaggucgccaagaaccucaacgagagccugaucgaccugcaggagcucgggaaguacgagcaguacaucaaguggccgugguacaucuggcugggcuucaucgccggccugaucgcgaucgugauggugaccaucaugcucugcugcaugaccuccugcugcagcugccugaaggggugcugcuccugcggcagcugcugcaaguucgacgaggacgacuccgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12751 - RNA, 4039 nt, Artificial Sequence
  SARS-CoV-2/Germany/BavPat1/2020__EPI_ISL_406862 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12752 - RNA, 4039 nt, Artificial Sequence
  SARS-CoV-2/Wuhan/HBCDC-HB-02/2020__EPI_ISL_412978 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaacuuccuccugcaguacggcuccuucugcacccagcugaaccgcgcgcucacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccugggggacaucgcggcccgcgaccucaucugcgcccagaaguucaacggccugaccgugcugccgccccuccugaccgacgagaugaucgcccaguacaccagcgcccugcucgcggggaccaucacguccggcuggaccuucggggccggcgccgcccugcagauccccuucgcgaugcagauggccuaccgguucaacggcaucggggucacccagaacgugcuguacgagaaccagaagcucaucgccaaccaguucaacagcgccaucggcaagauccaggacucccugagcuccaccgccagcgcgcuggggaagcuccaggacguggucaaccagaacgcccaggcccugaacacgcuggugaagcagcucuccagcaacuucggcgccaucuccagcgugcugaacgacauccugucccgccucgacaaggucgaggccgaggugcagaucgaccggcugaucaccgggcgccugcagagccuccagaccuacgugacccagcagcugauccgggcggccgagauccgcgccagcgccaaccuggccgcgaccaagauguccgagugcguccucggccagagcaagcggguggacuucugcggcaagggguaccaccugauguccuucccccagagcgccccgcacggcguggucuuccugcacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccuccagcccgagcuggacuccuucaaggaggagcuggacaaguacuucaagaaccacaccagccccgacgucgaccucggggacaucuccggcaucaacgccagcguggugaacauccagaaggagaucgaccgccugaacgaggucgccaagaaccugaacgagucccucaucgaccugcaggagcuggggaaguacgagcaguacaucaaguggccgugguacaucuggcucggcuucaucgccggccugaucgcgaucgugauggugaccaucaugcugugcugcaugaccagcugcugcuccugccucaaggggugcugcagcugcggcuccugcugcaaguucgacgaggacgacagcgagcccguccugaagggggugaagcugcacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12753 - RNA, 4039 nt, Artificial Sequence
  SARS-CoV-2/Australia/QLD02/2020__EPI_ISL_407896 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcuggagcucgacuccuucaaggaggagcuggacaaguacuucaagaaccacaccagccccgacgucgaccugggggacaucuccggcaucaacgccagcguggugaacauccagaaggagaucgaccgccucaacgaggucgccaagaaccugaacgagucccugaucgaccuccaggagcuggggaaguacgagcaguacaucaaguggcccugguacaucuggcugggcuucaucgccggccucaucgcgaucgugauggugaccaucaugcugugcugcaugaccagcugcugcuccugccugaaggggugcugcagcugcggcuccugcugcaaguucgacgaggacgacagcgagccgguccucaagggggugaagcugcacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12754 - RNA, 4039 nt, Artificial Sequence
  SARS-CoV-2/India/1-31/2020__EPI_ISL_413523 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgugaucggcaagauccaggacucccugagcuccaccgccagcgcccucgggaagcugcaggacgucgugaaccagaacgcgcaggcccugaacacgcucgugaagcagcuguccagcaacuucggcgccaucuccagcguccugaacgacauccucucccgccuggacaagguggaggccgaggugcagaucgaccggcugaucaccgggcgccuccagagccugcagaccuacgucacccagcagcugauccgggccgcggagauccgcgccagcgccaaccucgccgccaccaagauguccgagugcgugcugggccagagcaagcggguggacuucugcggcaagggguaccaccugauguccuucccccagagcgcgccgcacggcgucguguuccuccacgucacguacgugcccgcccaggagaagaacuucaccaccgcccccgccaucugccacgacgggaaggcgcacuucccccgcgagggcguguucgucuccaacgggacccacugguucgugacgcagcggaacuucuacgagccgcagaucaucaccaccgacaacaccuucgugagcggcaacugcgacgucgugaucggcaucgugaacaacacggucuacgacccccugcagcccgagcuggacuccuucaaggaggagcucgacaaguacuucaagaaccacaccagccccgacguggaccugggggacaucuccggcaucaacgccagcguggucaacauccagaaggagaucgaccgccugaacgagguggccaagaaccucaacgagucccugaucgaccugcaggagcucgggaaguacgagcaguacaucaaguggccgugguacaucuggcugggcuucaucgccggccugaucgccaucgugauggucaccaucaugcucugcugcaugaccagcugcugcuccugccugaaggggugcugcagcugcggcuccugcugcaaguucgacgaggacgacagcgagcccgugcugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12755 - RNA, 4039 nt, Artificial Sequence
  SARS-CoV-2/Guangdong/GD2020087-P0008/2020__EPI_ISL_413863 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccgggagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12756 - RNA, 4039 nt, Artificial Sequence
  SARS-CoV-2/Sweden/01/2020__EPI_ISL_411951 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacugcggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12757 - RNA, 4039 nt, Artificial Sequence
  SARS-CoV-2/Tianmen/HBCDC-HB-07/2020__EPI_ISL_412983 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggaccugaacugcaccgaggugcccgucgccauccacgccgaccagcucacgcccaccuggcggguguacuccaccggcagcaacguguuccagacccgcgccgggugccugaucggcgcggagcacgucaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcguggccuacuccaacaacagcaucgccauccccaccaacuucacgaucuccgucaccaccgagauccuccccgugagcaugaccaagacgagcguggacugcaccauguacaucugcggggacuccaccgagugcagcaaccugcugcuccaguacggcuccuucugcacccagcugaaccgcgcgcugacggggaucgccgucgagcaggacaagaacacccaggagguguucgcccaggugaagcagaucuacaagacgcccccgaucaaggacuucggcggguucaacuucagccagauccuccccgaccccuccaagcccagcaagcgguccuucaucgaggaccugcuguucaacaaggucacccucgccgacgccggcuucaucaagcaguacggcgacugccugggggacaucgcggcccgcgaccugaucugcgcccagaaguucaacggccucaccgugcugccgccccugcucaccgacgagaugaucgcccaguacaccagcgcccugcuggcggggaccaucacguccggcuggaccuucggggccggcgccgcccuccagauccccuucgcgaugcagauggccuaccgguucaacggcaucggggugacccagaacguccuguacgagaaccagaagcugaucgccaaccaguucaacagcgccaucggcaagauccaggacucccucagcuccaccgccagcgcgcuggggaagcugcaggacguggugaaccagaacgcccaggcccucaacacgcuggucaagcagcuguccagcaacuucggcgccaucuccagcgugcucaacgacauccugucccgccuggacaagguggaggccgagguccagaucgaccggcucaucaccgggcgccugcagagccugcagaccuacgugacccagcagcucauccgggcggccgagauccgcgccagcgccaaccuggccgcgaccaagauguccgagugcgugcugggccagagcaagcgggucgacuucugcggcaagggguaccaccucauguccuucccccagagcgccccgcacggcgugguguuccugcacgucacguacgugcccgcccaggagaagaacuucaccaccgcccccgcgaucugccacgacgggaaggcccacuucccccgcgagggcgucuucguguccaacgggacccacugguucgugacgcagcggaacuucuacgagccgcagaucaucaccaccgacaacaccuucgucagcggcaacugcgacguggugaucggcaucgucaacaacacgguguacgacccccugcagcccgagcucgacuccuucaaggaggagcuggacaaguacuucaagaaccacaccagccccgacguggaccugggggacaucuccggcaucaacgccagcgucgugaacauccagaaggagaucgaccgccucaacgagguggccaagaaccugaacgagucccugaucgaccuccaggagcuggggaaguacgagcaguacaucaaguggccgugguacaucuggcugggcuucaucgccggccucaucgcgaucgucauggugaccaucaugcugugcugcaugaccagcugcugcuccugccugaaggggugcugcagcugcggcuccugcugcaaguucgacgaggacgacagcgagcccgugcucaagggggucaagcugcacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12758 - RNA, 4039 nt, Artificial Sequence
  SARS-CoV-2/Hong Kong/case42_VM20002493/2020__EPI_ISL_414527 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucgcgaucuccgugacgaccgagauccugcccgugagcaugaccaagaccagcgucgacugcacgauguacaucugcggggacuccaccgagugcagcaaccuccugcugcaguacggcuccuucugcacccagcucaaccgcgcccugaccgggaucgccguggagcaggacaagaacacgcaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgcgggcuucaucaagcaguacggcgacugccucggggacaucgccgcccgcgaccugaucugcgcccagaaguucaacggccugaccgugcucccgccccugcugaccgacgagaugaucgcccaguacaccagcgcgcuccuggccgggaccaucaccuccggcuggacguucggggccggcgccgcgcugcagauccccuucgccaugcagauggccuaccgguucaacggcaucggggucacccagaacgugcucuacgagaaccagaagcugaucgccaaccaguucaacagcgccaucggcaagauccaggacucccugagcuccaccgcgagcgcccucgggaagcugcaggacguggucaaccagaacgcccaggcccugaacacccucgugaagcagcuguccagcaacuucggcgccaucuccagcgugcugaacgacauccucucccgccuggacaaggucgaggcggaggugcagaucgaccggcugaucacggggcgccuccagagccugcagaccuacgugacccagcagcugauccgggccgccgagauccgcgccagcgccaaccucgcggccaccaagauguccgagugcguccugggccagagcaagcggguggacuucugcggcaagggguaccaccugauguccuucccccagagcgccccgcacggcguggucuuccuccacgugaccuacguccccgcccaggagaagaacuucacgaccgcgcccgccaucugccacgacgggaaggcccacuucccccgcgagggcguguucguguccaacgggacccacugguucgucacccagcggaacuucuacgagccgcagaucaucacgaccgacaacaccuucgugagcggcaacugcgacguggucaucggcaucgugaacaacaccguguacgacccccugcagcccgagcuggacuccuucaaggaggagcucgacaaguacuucaagaaccacacgagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgcgggccugaucgccaucgugauggugaccaucaugcucugcugcaugaccagcugcugcuccugccugaaggggugcugcagcugcggcuccugcugcaaguucgacgaggacgacagcgagcccguccugaagggggugaagcuccacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12759 - RNA, 4039 nt, Artificial Sequence
  SARS-CoV-2/USA/CruiseA-23/2020__EPI_ISL_414482 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggaggugaagcagggcaacuucaagaaccuccgcgaguucgucuucaagaacaucgacggguacuucaagaucuacuccaagcacaccccgaucaaccuggugcgggaccugccccagggcuucagcgcccucgagccccugguggaccugcccaucgggaucaacaucacccgcuuccagacccuccuggcccugcaccgguccuaccucacgccgggcgacagcagcuccggguggaccgcgggcgccgccgccuacuacgucggcuaccugcagccccgcaccuuccugcucaaguacaacgagaacgggaccaucacggacgcgguggacugcgcccuggacccccugagcgagaccaagugcacccucaaguccuucaccguggagaagggcaucuaccagacgagcaacuuccggguccagcccaccgaguccaucgugcgcuucccgaacaucaccaaccugugccccuucggggaggucuucaacgccacccgguucgccagcguguacgccuggaaccgcaagcggaucuccaacugcguggcggacuacagcguccuguacaacuccgccagcuucuccacguucaagugcuacggcgugagccccaccaagcucaacgaccugugcuucaccaacguguacgccgacuccuucgucauccgcggcgacgaggugcggcagaucgcccccgggcagaccggcaagaucgccgacuacaacuacaagcugccggacgacuucacggggugcgugaucgcguggaacagcaacaaccucgacuccaaggucggcgggaacuacaacuaccuguaccgccuguuccgcaagagcaaccucaagcccuucgagcgggacaucuccaccgagaucuaccaggccggcagcacccccugcaacggcguggagggguucaacugcuacuucccccugcaguccuacggcuuccagccgaccaacggggugggcuaccagcccuaccgggucguggugcugagcuucgagcuccugcacgcccccgccacggucugcgggcccaagaaguccaccaaccuggugaagaacaagugcgugaacuucaacuucaacggccucaccggcaccgggguccugaccgagagcaacaagaaguuccugccguuccagcaguucggccgcgacaucgccgacacgaccgacgcggugcgcgacccccagacccuggagauccucgacaucacccccugcagcuucgggggcguguccgucaucacgccggggaccaacaccagcaaccagguggccgugcuguaccaggacgucaacugcaccgaggugcccguggccauccacgccgaccagcugacgcccaccuggcgggucuacuccaccggcagcaacguguuccagacccgcgccggcugccucaucggggcggagcacgugaacaacuccuacgagugcgacauccccaucggcgccgggaucugcgccagcuaccagacgcagaccaacuccccgcggcgcgcccggagcgucgcgucccagagcaucaucgccuacaccaugucccugggcgccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcgcugacgggcaucgccguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggguucaucaagcaguacggcgacugccucggcgacaucgcggcccgcgaccugaucugcgcccagaaguucaacgggcugaccguccucccgccccugcugaccgacgagaugaucgcccaguacaccagcgcccuccuggcgggcaccaucacguccggguggaccuucggcgccggggccgcccugcagauccccuucgcgaugcagauggccuaccgguucaacggcaucggcgugacccagaacgugcucuacgagaaccagaagcugaucgccaaccaguucaacagcgccaucgggaagauccaggacucccugagcuccaccgccagcgcgcucggcaagcugcaggacgucgugaaccagaacgcccaggcccugaacacgcucgugaagcagcuguccagcaacuucggggccaucuccagcguccugaacgacauccucucccgccuggacaagguggaggccgaggugcagaucgaccggcugaucaccggccgccuccagagccugcagaccuacgucacccagcagcugauccgggcggccgagauccgcgccagcgccaaccucgccgcgaccaagauguccgagugcgugcuggggcagagcaagcggguggacuucugcggcaagggcuaccaccugauguccuucccccagagcgccccgcacggggucguguuccuccacgucacguacgugcccgcccaggagaagaacuucaccaccgcccccgcgaucugccacgacggcaaggcccacuucccccgcgaggggguguucgucuccaacggcacccacugguucgugacgcagcggaacuucuacgagccgcagaucaucaccaccgacaacaccuucgugagcgggaacugcgacgucgugaucggcaucgugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggguucaucgccggccugaucgcgaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12760 - RNA, 4039 nt, Artificial Sequence
  SARS-CoV-2/Hong Kong/case85_VM20002868/2020__EPI_ISL_414519 spike protein mRNA gc (1-1273)
aggagaaagcuuaccauguucguguuccugguccucgugccccuggugagcucccagugcgucaaccugaccacccgcacgcagcucccgcccgccuacaccaacagcuucacccggggcguguacuaccccgacaagguguuccgcuccagcguccugcacuccacccaggaccuguuccuccccuucuucagcaacgugacgugguuccacgccauccacguguccgggaccaacggcaccaagcgguucgacaacccgguccugcccuucaacgacgggguguacuucgcgagcaccgagaaguccaacaucauccgcggcuggaucuucgggacgacccuggacagcaagacccagucccuccugaucgugaacaacgccaccaacgucgugaucaaggugugcgaguuccaguucugcaacgaccccuuccugggcgucuacuaccacaagaacaacaagagcuggauggaguccgaguuccggguguacagcuccgccaacaacugcacguucgaguacgugagccagcccuuccucauggaccuggagggcaagcaggggaacuucaagaaccugcgcgaguucgucuucaagaacaucgacggcuacuucaagaucuacuccaagcacaccccgaucaaccucgugcgggaccugccccagggguucagcgcccuggagccccucguggaccugcccaucggcaucaacaucacccgcuuccagacccugcucgcccugcaccgguccuaccugacgccgggggacagcagcuccggcuggaccgcgggcgccgccgccuacuacgucggguaccuccagccccgcaccuuccugcugaaguacaacgagaacggcaccaucacggacgcgguggacugcgcccucgacccccugagcgagaccaagugcacccugaaguccuucaccguggagaaggggaucuaccagacgagcaacuuccggguccagcccaccgaguccaucgugcgcuucccgaacaucaccaaccucugccccuucggcgaggucuucaacgccacccgguucgccagcguguacgccuggaaccgcaagcggaucuccaacugcguggcggacuacagcguccuguacaacuccgccagcuucuccacguucaagugcuacggcgugagccccaccaagcugaacgaccucugcuucaccaacguguacgccgacuccuucgucauccgcggggacgaggugcggcagaucgcccccggccagaccgggaagaucgccgacuacaacuacaagcugccggacgacuucacgggcugcgugaucgcguggaacagcaacaaccuggacuccaaggucgggggcaacuacaacuaccucuaccgccuguuccgcaagagcaaccugaagcccuucgagcgggacaucuccaccgagaucuaccaggccggcagcacccccugcaacgggguggagggcuucaacugcuacuucccccuccaguccuacggguuccagccgaccaacggcgugggguaccagcccuaccgggucguggugcugagcuucgagcugcuccacgcccccgccacggucugcggccccaagaaguccaccaaccuggugaagaacaagugcgugaacuucaacuucaacggccugaccgggaccggcguccucaccgagagcaacaagaaguuccugccguuccagcaguucgggcgcgacaucgccgacacgaccgacgcggugcgcgacccccagacccuggagauccuggacaucacccccugcagcuucggcgggguguccgucaucacgccgggcaccaacaccagcaaccagguggccgugcucuaccaggacgucaacugcaccgaggugcccguggccauccacgccgaccagcugacgcccaccuggcgggucuacuccaccggcagcaacguguuccagacccgcgccgggugccugaucggcgcggagcacgugaacaacuccuacgagugcgacauccccaucggggccggcaucugcgccagcuaccagacgcagaccaacuccccgcggcgcgcccggagcgucgcgucccagagcaucaucgccuacaccaugucccucggcgccgagaacagcguggccuacuccaacaacagcaucgccauccccaccaacuucacgaucuccgugaccaccgagauccugcccgucagcaugaccaagacgagcguggacugcaccauguacaucugcggggacuccaccgagugcagcaaccugcuccugcaguacggcuccuucugcacccagcugaaccgcgcgcucacggggaucgccguggagcaggacaagaacacccaggaggucuucgcccaggugaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccugggggacaucgcggcccgcgaccucaucugcgcccagaaguucaacggccugaccguccugccgccccuccugaccgacgagaugaucgcccaguacaccagcgcccugcucgcggggaccaucacguccggcuggaccuucggggccggcgccgcccugcagauccccuucgcgaugcagauggccuaccgguucaacggcaucggggugacccagaacgugcuguacgagaaccagaagcucaucgccaaccaguucaacagcgccaucggcaagauccaggacucccugagcuccaccgccagcgcgcuggggaagcuccaggacgucgugaaccagaacgcccaggcccugaacacgcuggugaagcagcucuccagcaacuucggcgccaucuccagcguccugaacgacauccugucccgccucgacaagguggaggccgaggugcagaucgaccggcugaucaccgggcgccugcagagccuccagaccuacgucacccagcagcugauccgggcggccgagauccgcgccagcgccaaccuggccgcgaccaagauguccgagugcgugcucggccagagcaagcggguggacuucugcggcaagggguaccaccugauguccuucccccagagcgccccgcacggcgucguguuccugcacgucacguacgugcccgcccaggagaagaacuucaccaccgcccccgcgaucugccacgacgggaaggcccacuucccccgcgagggcguguucgucuccaacgggacccacugguucgugacgcagcggaacuucuacgagccgcagaucaucaccaccgacaacaccuucgugagcggcaacugcgacgucgugaucggcaucgugaacaacacggucuacgacccccuccagcccgagcuggacuccuucaaggaggagcuggacaaguacuucaagaaccacaccagccccgacguggaccucggggacaucuccggcaucaacgccagcguggucaacauccagaaggagaucgaccgccugaacgagguggccaagaaccugaacgagucccucaucgaccugcaggagcuggggaaguacgagcaguacaucaaguggccgugguacaucuggcucggcuucaucgccggccugaucgcgaucgugauggucaccaucaugcugugcugcaugaccagcugcugcuccugccucaaggggugcugcagcugcggcuccugcugcaaguucgacgaggacgacagcgagcccgugcugaagggggugaagcugcacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12761 - RNA, 4039 nt, Artificial Sequence
  SARS-CoV-2/England/200990660/2020__EPI_ISL_414523 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcugguccucaagggcgugaagcugcacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12762 - RNA, 4039 nt, Artificial Sequence
  SARS-CoV-2/Australia/NSW09/2020__EPI_ISL_413595 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuucaccgccuccgcgcucgggaagcugcaggacguggucaaccagaacgcccaggcccugaacacgcucgugaagcagcugagcuccaacuucggcgccaucagcuccgugcugaacgacauccucagccgccuggacaaggucgaggccgaggugcagaucgaccggcugaucaccgggcgccuccagucccugcagaccuacgugacccagcagcugauccgggcggccgagauccgcgccagcgccaaccucgccgcgaccaagaugagcgagugcguccugggccaguccaagcggguggacuucugcggcaagggguaccaccugaugagcuucccccaguccgccccgcacggcguggucuuccuccacgugacguacguccccgcccaggagaagaacuucaccaccgcccccgcgaucugccacgacgggaaggcccacuucccccgcgagggcguguucgugagcaacgggacccacugguucgucacgcagcggaacuucuacgagccgcagaucaucaccaccgacaacaccuucguguccggcaacugcgacguggucaucggcaucgugaacaacacgguguacgacccccugcagcccgagcuggacagcuucaaggaggagcucgacaaguacuucaagaaccacaccucccccgacgucgaccugggggacaucagcggcaucaacgccuccguggugaacauccagaaggagaucgaccgccugaacgaggucgccaagaaccucaacgagagccugaucgaccugcaggagcucgggaaguacgagcaguacaucaaguggccgugguacaucuggcugggcuucaucgccggccugaucgcgaucgugauggugaccaucaugcucugcugcaugaccuccugcugcagcugccugaaggggugcugcuccugcggcagcugcugcaaguucgacgaggacgacuccgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12763 - RNA, 4039 nt, Artificial Sequence
  SARS-CoV-2/Australia/NSW10/2020__EPI_ISL_413596 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcuucaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12764 - RNA, 4039 nt, Artificial Sequence
  SARS-CoV-2/Switzerland/1000477797/2020__EPI_ISL_413023 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaacaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12765 - RNA, 4039 nt, Artificial Sequence
  SARS-CoV-2/Belgium/BA-02291/2020__EPI_ISL_415159 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccggcgcagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccgcguggucgugcugagcuucgagcuccugcccgcccccgccacggugugcggcccgaagaaguccaccaaccuggucaagaacaagugcgugaacuucaacuucaacggccucaccgggaccggcgugcugaccgaguccaacaagaaguuccugcccuuccagcaguucgggcgcgacaucgccgacacgaccgacgcgguccgggacccccagacccuggagauccucgacaucaccccgugcagcuucggcgggguguccgugaucacgcccggcaccaacaccagcaaccaggucgccgugcuguaccagggcgugaacugcaccgagguccccguggccauccacgccgaccagcugacgcccaccuggcgcguguacuccaccgggagcaacgucuuccagacccgggccggcugccucaucggggcggagcacgugaacaacuccuacgagugcgacaucccgaucggcgccggcaucugcgccagcuaccagacgcagaccaacagcccccgccgggcccgcagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgggcgcugacgggcaucgccguggagcaggacaagaacacccaggagguguucgcccaggucaagcagaucuacaagaccccgcccaucaaggacuucgggggcuucaacuucagccagauccugcccgaccccuccaagccgagcaagcgcuccuucaucgaggaccuccuguucaacaaggugacccuggccgacgccggcuucaucaagcaguacggggacugccucggcgacaucgcggcccgggaccugaucugcgcccagaaguucaacgggcugacggugcucccgccccugcugaccgacgagaugaucgcccaguacaccagcgcccuccuggcgggcaccaucacguccggguggaccuucggcgccggcgccgcccugcagauccccuucgcgaugcagauggccuaccgcuucaacgggaucggcgucacccagaacgugcucuacgagaaccagaagcugaucgccaaccaguucaacagcgccaucgggaagauccaggacucccugagcuccgccgcgcccgcccucggcaagcugcaggacguggucaaccagaacgcccaggcccugaacacccucgugaagcagcugagcuccaacuucggggccaucagcuccgugcugaacgacauccucagccggcuggacaaggucgaggcggaggugcagaucgaccgccugaucacgggccggcuccagucccugcagaccuacgugacccagcagcugauccgcgccgccgagauccgggccagcgccaaccucgcggccaccaagaugagcgagugcguccugggccaguccaagcgcguggacuucugcgggaagggcuaccaccugaugagcuucccccaguccgcgccccacgggguggucuuccuccacgugaccuacguccccgcccaggagaagaacuucacgaccgccccggccaucugccacgacggcaaggcccacuucccccgggaggggguguucgugagcaacggcacccacugguucgucacccagcgcaacuucuacgagccccagaucaucacgaccgacaacaccuucguguccggcaacugcgacguggucaucgggaucgugaacaacaccguguacgacccccugcagccggagcuggacagcuucaaggaggagcucgacaaguacuucaagaaccacacgucccccgacgucgaccugggcgacaucagcgggaucaacgccuccguggugaacauccagaaggagaucgaccggcugaacgaggucgccaagaaccucaacgagagccugaucgaccugcaggagcucggcaaguacgagcaguacaucaaguggcccugguacaucuggcugggcuucaucgcggggcugaucgccaucgugauggugaccaucaugcucugcugcaugaccuccugcugcagcugccugaagggcugcugcuccugcgggagcugcugcaaguucgacgaggacgacuccgagccgguccugaagggcgugaagcuccacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12766 - RNA, 4039 nt, Artificial Sequence
  SARS-CoV-2/USA/WA8-UW5/2020__EPI_ISL_413486 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12767 - RNA, 4039 nt, Artificial Sequence
  SARS-CoV-2/England/20102000506/2020__EPI_ISL_415147 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggguacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12768 - RNA, 4039 nt, Artificial Sequence
  SARS-CoV-2/Belgium/VAG-03013/2020__EPI_ISL_415155 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccacggcgcucggcaagcugcaggacguggucaaccagaacgcccaggcccugaacacccucgugaagcagcugagcuccaacuucggggccaucagcuccgugcugaacgacauccucagccgccuggacaaggucgaggccgaggugcagaucgaccggcugaucaccggccgccuccagucccugcagaccuacgugacccagcagcugauccgggcggccgagauccgcgccagcgccaaccucgccgcgacgaagaugagcgagugcguccugggccaguccaagcggguggacuucugcgggaagggcuaccaccugaugagcuucccccaguccgccccgcacgggguggucuuccuccacgugaccuacguccccgcccaggagaagaacuucaccaccgcccccgcgaucugccacgacggcaaggcccacuucccccgcgaggggguguucgugagcaacggcacgcacugguucgucacccagcggaacuucuacgagccgcagaucaucaccaccgacaacacguucguguccggcaacugcgacguggucaucgggaucgugaacaacaccguguacgacccccugcagcccgagcuggacagcuucaaggaggagcucgacaaguacuucaagaaccacaccucccccgacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggccgugguacaucuggcugggcuucaucgccgggcugaucgcgaucgugauggugaccaucaugcucugcugcaugacguccugcugcagcugccugaagggcugcugcuccugcgggagcugcugcaaguucgacgaggacgacuccgagcccguccugaagggcgugaagcuccacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12769 - RNA, 4039 nt, Artificial Sequence
  SARS-CoV-2/Belgium/BC-03016/2020__EPI_ISL_415157 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgcccccgcgcucggcaagcugcaggacguggucaaccagaacgcccaggcccugaacacgcucgugaagcagcugagcuccaacuucggggccaucagcuccgugcugaacgacauccucagccgccuggacaaggucgaggccgaggugcagaucgaccggcugaucaccggccgccuccagucccugcagaccuacgugacccagcagcugauccgggcggccgagauccgcgccagcgccaaccucgccgcgaccaagaugagcgagugcguccugggccaguccaagcggguggacuucugcgggaagggcuaccaccugaugagcuucccgcaguccgcgccccacgggguggucuuccuccacgugacguacguccccgcccaggagaagaacuucaccaccgcccccgccaucugccacgacggcaaggcccacuucccgcgcgaggggguguucgugagcaacggcacccacugguucgucacgcagcggaacuucuacgagccccagaucaucaccaccgacaacaccuucguguccggcaacugcgacguggucaucgggaucgugaacaacacgguguacgacccccugcagcccgagcuggacagcuucaaggaggagcucgacaaguacuucaagaaccacaccuccccggacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggcccugguacaucuggcugggcuucaucgccgggcugaucgcgaucgugauggugaccaucaugcucugcugcaugaccuccugcugcagcugccugaagggcugcugcuccugcgggagcugcugcaaguucgacgaggacgacuccgagcccguccugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12770 - RNA, 4039 nt, Artificial Sequence
  SARS-CoV-2/Germany/BavPat3/2020__EPI_ISL_414521 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccagcaggucuucgcccaggugaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12771 - RNA, 4039 nt, Artificial Sequence
  SARS-CoV-2/France/HF1805/2020__EPI_ISL_414628 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggguggugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12772 - RNA, 4039 nt, Artificial Sequence
  SARS-CoV-2/Netherlands/ZuidHolland_9/2020__EPI_ISL_414445 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgugcagaaguucaacgggcugaccguccucccgccccugcugaccgacgagaugaucgcccaguacaccagcgcccuccuggccggcaccaucacguccggguggaccuucggcgcgggcgccgcccugcagauccccuucgccaugcagauggcguaccgguucaacgggaucggcgugacccagaacgugcucuacgagaaccagaagcugaucgccaaccaguucaacagcgccaucgggaagauccaggacucccugagcuccaccgccagcgcccucggcaagcugcaggacgucgugaaccagaacgcgcaggcccugaacacgcucgugaagcagcuguccagcaacuucggggccaucuccagcguccugaacgacauccucucccgccuggacaagguggaggccgaggugcagaucgaccggcugaucaccggccgccuccagagccugcagaccuacgucacccagcagcugauccgggccgcggagauccgcgccagcgccaaccucgccgccaccaagauguccgagugcgugcugggccagagcaagcggguggacuucugcgggaagggcuaccaccugauguccuucccccagagcgcgccgcacggggucguguuccuccacgucacguacgugcccgcccaggagaagaacuucaccaccgcccccgccaucugccacgacggcaaggcgcacuucccccgcgaggggguguucgucuccaacggcacccacugguucgugacgcagcggaacuucuacgagccgcagaucaucaccaccgacaacaccuucgugagcggcaacugcgacgucgugaucgggaucgugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgccaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12773 - RNA, 4039 nt, Artificial Sequence
  SARS-CoV-2/Finland/FIN03032020A/2020__EPI_ISL_413602 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucagcuggaacuccaacaaccucgacagcaaggucgggggcaacuacaacuaccuguaccgccuguuccggaaguccaaccucaagcccuucgagcgcgacaucagcaccgagaucuaccaggcgggcuccacccccugcaacgggguggagggcuucaacugcuacuucccccugcagagcuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgcgacccccagacccuggagauccucgacaucacccccugcuccuucggcggggugagcgugaucacgccgggcaccaacaccuccaaccaggucgcggugcuguaccagggcgugaacugcaccgagguccccguggccauccacgccgaccagcugacgcccaccuggcggguguacagcaccggguccaacgucuuccagacccgcgccggcugccucaucggggccgagcacgugaacaacagcuacgagugcgacauccccaucggcgcgggcaucugcgccuccuaccagacgcagaccaacagcccgcggcgcgcccgguccguggccagccaguccaucaucgcguacaccaugagccugggggccgagaacuccgucgccuacagcaacaacuccaucgccauccccaccaacuucacgaucagcgugaccaccgagauccugcccgugagcaugaccaagacguccgucgacugcaccauguacaucugcggcgacagcaccgagugcuccaaccuccugcugcaguacgggagcuucugcacccagcucaaccgcgcccugacgggcaucgcgguggagcaggacaagaacacccaggagguguucgcccaggucaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgccgcgcgcgaccugaucugcgcccagaaguucaacgggcugaccgugcucccgccccugcugaccgacgagaugaucgcccaguacaccuccgcccuccuggccggcaccaucacgagcggguggaccuucggcgcgggcgccgcccugcagauccccuucgccaugcagauggcguaccgguucaacgggaucggcgucacccagaacgugcucuacgagaaccagaagcugaucgccaaccaguucaacuccgccaucgggaagauccaggacagccuguccagcaccgccuccgcccucggcaagcugcaggacguggucaaccagaacgcgcaggcccugaacacgcucgugaagcagcugagcuccaacuucggggccaucagcuccgugcugaacgacauccucagccgccuggacaaggucgaggccgaggugcagaucgaccggcugaucaccggccgccuccagagccugcagaccuacgugacccagcagcugauccgggccgcggagauccgcgccuccgccaaccucgccgccaccaagaugagcgagugcguccugggccaguccaagcggguggacuucugcgggaagggcuaccaccugaugagcuucccccaguccgcgccgcacgggguggucuuccuccacgugacguacguccccgcccaggagaagaacuucaccaccgcccccgccaucugccacgacggcaaggcgcacuucccccgcgaggggguguucgugagcaacggcacccacugguucgucacgcagcggaacuucuacgagccgcagaucaucaccaccgacaacaccuucguguccggcaacugcgacguggucaucgggaucgugaacaacacgguguacgacccccugcagcccgagcuggacagcuucaaggaggagcucgacaaguacuucaagaaccacaccucccccgacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggccgugguacaucuggcugggcuucaucgccgggcugaucgccaucgugauggugaccaucaugcucugcugcaugaccuccugcugcagcugccugaagggcugcugcuccugcgggagcugcugcaaguucgacgaggacgacuccgagcccguccugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12774 - RNA, 4039 nt, Artificial Sequence
  SARS-CoV-2/France/GE1977/2020__EPI_ISL_414632 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccuguucagcaccgccuccgcgcucggcaagcugcaggacguggucaaccagaacgcccaggcccugaacacgcucgugaagcagcugagcuccaacuucggggccaucagcuccgugcugaacgacauccucagccgccuggacaaggucgaggccgaggugcagaucgaccggcugaucaccggccgccuccagucccugcagaccuacgugacccagcagcugauccgggcggccgagauccgcgccagcgccaaccucgccgcgaccaagaugagcgagugcguccugggccaguccaagcggguggacuucugcgggaagggcuaccaccugaugagcuucccccaguccgccccgcacgggguggucuuccuccacgugacguacguccccgcccaggagaagaacuucaccaccgcccccgcgaucugccacgacggcaaggcccacuucccccgcgaggggguguucgugagcaacggcacccacugguucgucacgcagcggaacuucuacgagccgcagaucaucaccaccgacaacaccuucguguccggcaacugcgacguggucaucgggaucgugaacaacacgguguacgacccccugcagcccgagcuggacagcuucaaggaggagcucgacaaguacuucaagaaccacaccucccccgacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggccgugguacaucuggcugggcuucaucgccgggcugaucgcgaucgugauggugaccaucaugcucugcugcaugaccuccugcugcagcugccugaagggcugcugcuccugcgggagcugcugcaaguucgacgaggacgacuccgagcccguccugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12775 - RNA, 4039 nt, Artificial Sequence
  SARS-CoV-2/Finland/FIN-313/2020__EPI_ISL_414641 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuucaagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12776 - RNA, 4039 nt, Artificial Sequence
  SARS-CoV-2/Netherlands/ZuidHolland_2/2020__EPI_ISL_414556 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgcccuggagcaggacaagaacacccaggagguguucgcccaggugaagcagaucuacaagacgcccccgaucaaggacuucgggggcuucaacuucagccagauccuccccgaccccuccaagcccagcaagcgguccuucaucgaggaccugcuguucaacaaggucacccucgccgacgccggcuucaucaagcaguacggggacugccugggcgacaucgcggcccgcgaccugaucugcgcccagaaguucaacgggcucaccgugcugccgccccugcucaccgacgagaugaucgcccaguacaccagcgcccugcuggcgggcaccaucacguccggguggaccuucggcgccggcgccgcccuccagauccccuucgcgaugcagauggccuaccgguucaacgggaucggcgugacccagaacguccuguacgagaaccagaagcugaucgccaaccaguucaacagcgccaucgggaagauccaggacucccucagcuccaccgccagcgcgcugggcaagcugcaggacguggugaaccagaacgcccaggcccucaacacgcuggucaagcagcuguccagcaacuucggggccaucuccagcgugcucaacgacauccugucccgccuggacaagguggaggccgagguccagaucgaccggcucaucaccggccgccugcagagccugcagaccuacgugacccagcagcucauccgggcggccgagauccgcgccagcgccaaccuggccgcgaccaagauguccgagugcgugcugggccagagcaagcgggucgacuucugcgggaagggcuaccaccucauguccuucccccagagcgccccgcacggggugguguuccugcacgucacguacgugcccgcccaggagaagaacuucaccaccgcccccgcgaucugccacgacggcaaggcccacuucccccgcgagggggucuucguguccaacggcacccacugguucgugacgcagcggaacuucuacgagccgcagaucaucaccaccgacaacaccuucgucagcggcaacugcgacguggugaucgggaucgucaacaacacgguguacgacccccugcagcccgagcucgacuccuucaaggaggagcuggacaaguacuucaagaaccacaccagccccgacguggaccugggcgacaucuccgggaucaacgccagcgucgugaacauccagaaggagaucgaccgccucaacgagguggccaagaaccugaacgagucccugaucgaccuccaggagcugggcaaguacgagcaguacaucaaguggccgugguacaucuggcugggcuucaucgccgggcucaucgcgaucgucauggugaccaucaugcugugcugcaugaccagcugcugcuccugccugaagggcugcugcagcugcggguccugcugcaaguucgacgaggacgacagcgagcccgugcucaagggcgucaagcugcacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12777 - RNA, 4039 nt, Artificial Sequence
  SARS-CoV-2/USA/WA-UW31/2020__EPI_ISL_414618 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggccgagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgcggacacgaccgacgccgugcgcgacccccagacccuggagauccucgacaucacccccugcagcuucggcggggucuccgugaucacgccgggcaccaacaccagcaaccagguggccguccuguaccaggacgugaacugcaccgaggugcccgucgccauccacgccgaccagcugacgcccaccuggcggguguacuccaccggcagcaacguguuccagacccgcgcggggugccucaucggcgccgagcacgucaacaacuccuacgagugcgacauccccaucggggccggcaucugcgccagcuaccagacgcagaccaacuccccgcggcgcgcgcggagcguggccucccagagcaucaucgccuacaccaugucccugggcgccgagaacagcguggccuacuccaacaacagcaucgcgauccccaccaacuucacgaucuccgucaccaccgagauccugcccgugagcaugaccaagacgagcguggacugcaccauguacaucugcggggacuccaccgagugcagcaaccuccugcugcaguacggcuccuucugcacccagcucaaccgcgcccugacggggaucgccgucgagcaggacaagaacacccaggagguguucgcccaggugaagcagaucuacaagacgcccccgaucaaggacuucggcggguucaacuucagccagauccugcccgaccccuccaagcccagcaagcgguccuucaucgaggaccuccuguucaacaaggucacccuggccgacgcgggcuucaucaagcaguacggcgacugccucggggacaucgccgcccgcgaccugaucugcgcccagaaguucaacggccugaccgugcucccgccccugcugaccgacgagaugaucgcccaguacaccagcgcgcuccuggccgggaccaucacguccggcuggaccuucggggccggcgccgcgcugcagauccccuucgccaugcagauggccuaccgguucaacggcaucggggugacccagaacguccucuacgagaaccagaagcugaucgccaaccaguucaacagcgccaucggcaagauccaggacucccugagcuccaccgcgagcgcccucgggaagcugcaggacguggugaaccagaacgcccaggcccugaacacgcucgucaagcagcuguccagcaacuucggcgccaucuccagcgugcugaacgacauccucucccgccuggacaagguggaggcggagguccagaucgaccggcugaucaccgggcgccuccagagccugcagaccuacgugacccagcagcugauccgggccgccgagauccgcgccagcgccaaccucgcggccaccaagauguccgagugcgugcugggccagagcaagcgggucgacuucugcggcaagggguaccaccugauguccuucccccagagcgccccgcacggcgugguguuccuccacgucacguacgugcccgcccaggagaagaacuucaccaccgcgcccgccaucugccacgacgggaaggcccacuucccccgcgagggcgucuucguguccaacgggacccacugguucgugacgcagcggaacuucuacgagccgcagaucaucaccaccgacaacaccuucgucagcggcaacugcgacguggugaucggcaucgucaacaacacgguguacgacccccugcagcccgagcuggacuccuucaaggaggagcucgacaaguacuucaagaaccacaccagccccgacguggaccugggggacaucuccggcaucaacgccagcgucgugaacauccagaaggagaucgaccgccugaacgagguggccaagaaccucaacgagucccugaucgaccugcaggagcucgggaaguacgagcaguacaucaaguggccgugguacaucuggcugggcuucaucgcgggccugaucgccaucgucauggugaccaucaugcucugcugcaugaccagcugcugcuccugccugaaggggugcugcagcugcggcuccugcugcaaguucgacgaggacgacagcgagcccgugcugaagggggucaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12778 - RNA, 4039 nt, Artificial Sequence
  SARS-CoV-2/South Korea/SNU01/2020__EPI_ISL_411929 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucugggcccucgagccccugguggaccugcccaucggcaucaacaucacccgcuuccagacccuccuggcccugcaccggagcuaccucacgccgggggacuccagcagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccacccgguucgccuccgucuacgccuggaaccgcaagcggaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccuguaccgccuguuccggaaguccaaccucaagcccuucgagcgcgacaucagcaccgagaucuaccaggccggcuccacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcggggugagcgugaucacgccgggcaccaacaccuccaaccaggucgccgugcuguaccaggacgugaacugcaccgagguccccguggccauccacgccgaccagcugacgcccaccuggcggguguacagcaccggcuccaacgucuuccagacccgcgccgggugccucaucggcgcggagcacgugaacaacagcuacgagugcgacauccccaucggggccggcaucugcgccuccuaccagacgcagaccaacagcccgcggcgcgcccgguccguggcgagccaguccaucaucgccuacaccaugagccugggcgccgagaacuccgucgccuacagcaacaacuccaucgccauccccaccaacuucacgaucagcgugaccaccgagauccugcccguguccaugaccaagacgagcgucgacugcaccauguacaucugcggggacagcaccgagugcuccaaccuccugcugcaguacggcagcuucugcacccagcucaaccgcgcgcugacggggaucgccguggagcaggacaagaacacccaggagguguucgcccaggucaagcagaucuacaagacgcccccgaucaaggacuucggcggguucaacuucucccagauccugcccgaccccagcaagcccuccaagcggagcuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccuccgcccuccuggcggggaccaucacgagcggcuggaccuucggggccggcgccgcccugcagauccccuucgcgaugcagauggccuaccgguucaacggcaucggggucacccagaacgugcucuacgagaaccagaagcugaucgccaaccaguucaacuccgccaucggcaagauccaggacagccuguccagcaccgccuccgcgcucgggaagcugcaggacguggucaaccagaacgcccaggcccugaacacgcucgugaagcagcugagcuccaacuucggcgccaucagcuccgugcugaacgacauccucagccgccuggacaaggucgaggccgaggugcagaucgaccggcugaucaccgggcgccuccagucccugcagaccuacgugacccagcagcugauccgggcggccgagauccgcgccagcgccaaccucgccgcgaccaagaugagcgagugcguccugggccaguccaagcggguggacuucugcggcaagggguaccaccugaugagcuucccccaguccgccccgcacggcguggucuuccuccacgugacguacguccccgcccaggagaagaacuucaccaccgcccccgcgaucugccacgacgggaaggcccacuucccccgcgagggcguguucgugagcaacgggacccacugguucgucacgcagcggaacuucuacgagccgcagaucaucaccaccgacaacaccuucguguccggcaacugcgacguggucaucggcaucgugaacaacacgguguacgacccccugcagcccgagcuggacagcuucaaggaggagcucgacaaguacuucaagaaccacaccucccccgacgucgaccugggggacaucagcggcaucaacgccuccguggugaacauccagaaggagaucgaccgccugaacgaggucgccaagaaccucaacgagagccugaucgaccugcaggagcucgggaaguacgagcaguacaucaaguggccgugguacaucuggcugggcuucaucgccggccugaucgcgaucgugauggugaccaucaugcucugcugcaugaccuccugcugcagcugccugaaggggugcugcuccugcggcagcugcugcaaguucgacgaggacgacuccgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12779 - RNA, 4039 nt, Artificial Sequence
  SARS-CoV-2/China/WF0004/2020__EPI_ISL_413694 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggacggaguccgaguuccgggucuacagcuccgccaacaacugcaccuucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacgcuccuggcccugcaccgguccuaccucaccccgggggacagcagcuccggcuggaccgcgggcgccgccgccuacuacgugggguaccugcagccccgcaccuuccugcucaaguacaacgagaacggcacgaucaccgacgcggucgacugcgcccuggacccccugagcgagaccaagugcacccucaaguccuucacgguggagaaggggaucuaccagaccagcaacuuccgggugcagcccaccgaguccaucguccgcuucccgaacaucaccaaccugugccccuucggcgagguguucaacgccacgcgguucgccagcgucuacgccuggaaccgcaagcggaucuccaacugcguggcggacuacagcgugcuguacaacuccgccagcuucuccaccuucaagugcuacggcgucagccccaccaagcucaacgaccugugcuucaccaacguguacgccgacuccuucgugauccgcggggacgagguccggcagaucgcccccggccagacggggaagaucgccgacuacaacuacaagcugccggacgacuucaccggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgacgaacggcgugggguaccagcccuaccggguggucgugcugagcuucgagcuccugcacgcccccgccaccgugugcggccccaagaaguccaccaaccuggucaagaacaagugcgugaacuucaacuucaacggccucaccgggaccggcgugcugacggagagcaacaagaaguuccugccguuccagcaguucgggcgcgacaucgccgacaccaccgacgcgguccgcgacccccagacccuggagauccucgacaucacgcccugcagcuucggcgggguguccgugaucaccccgggcaccaacaccagcaaccaggucgccgugcuguaccaggacgugaacugcacggagguccccguggccauccacgccgaccagcugacccccaccuggcggguguacuccaccggcagcaacgucuuccagacgcgcgccgggugccucaucggcgcggagcacgugaacaacuccuacgagugcgacauccccaucggggccggcaucugcgccagcuaccagacccagaccaacuccccgcggcgcgcccggagcguggcgucccagagcaucaucgccuacaccaugucccugggcgccgagaacagcgucgccuacuccaacaacagcaucgccauccccacgaacuucaccaucuccgugaccaccgagauccugcccgugagcaugacgaagaccagcgucgacugcaccauguacaucugcggggacuccaccgagugcagcaaccuccugcugcaguacggcuccuucugcacgcagcucaaccgcgcgcugaccgggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggacgaucaccuccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccacggccagcgcgcucgggaagcugcaggacguggucaaccagaacgcccaggcccugaacacccucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgacgaagauguccgagugcguccugggccagagcaagcgguucgacuucugcggcaagggguaccaccugauguccuucccccagagcgccccgcacggcgugguguuccuccacgucaccuacgugcccgcccaggagaagaacuucaccaccgcccccgcgaucugccacgacgggaaggcccacuucccccgcgagggcgucuucguguccaacgggacgcacugguucgugacccagcggaacuucuacgagccgcagaucaucaccaccgacaacacguucgucagcggcaacugcgacguggugaucggcaucgucaacaacaccguguacgacccccugcagcccgagcuggacuccuucaaggaggagcucgacaaguacuucaagaaccacaccagccccgacguggaccugggggacaucuccggcaucaacgccagcgucgugaacauccagaaggagaucgaccgccugaacgagguggccaagaaccucaacgagucccugaucgaccugcaggagcucgggaaguacgagcaguacaucaaguggccgugguacaucuggcugggcuucaucgccggccugaucgcgaucgucauggugaccaucaugcucugcugcaugacgagcugcugcuccugccugaaggggugcugcagcugcggcuccugcugcaaguucgacgaggacgacagcgagcccgugcugaagggggucaagcuccacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12780 - RNA, 4039 nt, Artificial Sequence
  SARS-CoV-2/China/WF0028/2020__EPI_ISL_413791 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggaguccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12781 - RNA, 4039 nt, Artificial Sequence
  SARS-CoV-2/2019-nCoV/USA-CruiseA-18/2020__MT159716.1 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgagcugcgggucuacagcuccgccaacaacugcacguucgaguacgugagccagcccuuccugauggaccucgagggcaagcaggggaacuucaagaaccugcgcgaguucguguucaagaacaucgacggcuacuucaagaucuacuccaagcacaccccgaucaaccugguccgggaccucccccagggguucagcgcccuggagccccugguggaccuccccaucggcaucaacaucacccgcuuccagacccugcuggcccuccaccgguccuaccugacgccgggggacagcagcuccggcuggaccgcgggcgccgccgccuacuacgugggguaccugcagccccgcaccuuccuccugaaguacaacgagaacggcaccaucacggacgcggucgacugcgcccuggacccccucagcgagaccaagugcacccugaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcucuacaacuccgccagcuucuccacguucaagugcuacggcgucagccccaccaagcugaacgaccugugcuucaccaacguguacgccgacuccuucgugauccgcggggacgagguccggcagaucgcccccggccagaccgggaagaucgccgacuacaacuacaagcucccggacgacuucacgggcugcgugaucgcguggaacagcaacaaccuggacuccaaggucgggggcaacuacaacuaccuguaccgccucuuccgcaagagcaaccugaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcucagcuucgagcugcugcacgcccccgccacggugugcggccccaagaaguccaccaaccucgucaagaacaagugcgugaacuucaacuucaacggccugaccgggaccggcgugcugaccgagagcaacaagaaguuccugccguuccagcaguucgggcgcgacaucgccgacacgaccgacgcgguccgcgacccccagacccucgagauccuggacaucacccccugcagcuucggcgggguguccgugaucacgccgggcaccaacaccagcaaccaggucgccgugcuguaccaggacgugaacugcaccgagguccccguggccauccacgccgaccagcucacgcccaccuggcggguguacuccaccggcagcaacgucuuccagacccgcgccgggugccugaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccuccccgugagcaugaccaagacgagcgucgacugcaccauguacaucugcggggacuccaccgagugcagcaaccugcugcuccaguacggcuccuucugcacccagcugaaccgcgcgcugacggggaucgccguggagcaggacaagaacacccaggagguguucgcccaggucaagcagaucuacaagacgcccccgaucaaggacuucggcggguucaacuucagccagauccuccccgaccccuccaagcccagcaagcgguccuucaucgaggaccugcuguucaacaaggugacccucgccgacgccggcuucaucaagcaguacggcgacugccugggggacaucgcggcccgcgaccugaucugcgcccagaaguucaacggccucaccgugcugccgccccugcucaccgacgagaugaucgcccaguacaccagcgcccugcuggcggggaccaucacguccggcuggaccuucggggccggcgccgcccuccagauccccuucgcgaugcagauggccuaccgguucaacggcaucggggucacccagaacgugcuguacgagaaccagaagcugaucgccaaccaguucaacagcgccaucggcaagauccaggacucccucagcuccaccgccagcgcgcuggggaagcugcaggacguggucaaccagaacgcccaggcccucaacacgcuggugaagcagcuguccagcaacuucggcgccaucuccagcgugcucaacgacauccugucccgccuggacaaggucgaggccgaggugcagaucgaccggcucaucaccgggcgccugcagagccugcagaccuacgugacccagcagcucauccgggcggccgagauccgcgccagcgccaaccuggccgcgaccaagauguccgagugcguccugggccagagcaagcggguggacuucugcggcaagggguaccaccucauguccuucccccagagcgccccgcacggcguggucuuccugcacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcucgacuccuucaaggaggagcuggacaaguacuucaagaaccacaccagccccgacgucgaccugggggacaucuccggcaucaacgccagcguggugaacauccagaaggagaucgaccgccucaacgaggucgccaagaaccugaacgagucccugaucgaccuccaggagcuggggaaguacgagcaguacaucaaguggccgugguacaucuggcugggcuucaucgccggccucaucgcgaucgugauggugaccaucaugcugugcugcaugaccagcugcugcuccugccugaaggggugcugcagcugcggcuccugcugcaaguucgacgaggacgacagcgagcccguccucaagggggugaagcugcacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12782 - RNA, 4039 nt, Artificial Sequence
  SARS-CoV-2/SARS-CoV-2/Yunnan-01/human/2020/CHN__MT049951.1 spike protein mRNA gc (1-1273)
aggagaaagcuuaccauguucguguuccugguccuccugccccuggugagcucccagugcgugaaccucaccacccgcacgcagcugccgcccgccaacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12783 - RNA, 4039 nt, Artificial Sequence
  SARS-CoV-2/USA/WA-UW292/2020__EPI_ISL_418077 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccagcuccacccccugcaacggcguggagggguucaacugcuacuucccccugcagagcuacggcuuccagccgaccaacggggugggcuaccagcccuaccggguggucgugcugagcuucgagcuccugcacgcccccgccacggugugcgggcccaagaaguccaccaaccuggucaagaacaagugcgugaacuucaacuucaacggccucaccggcaccggggugcugaccgagagcaacaagaaguuccugccguuccagcaguucggccgcgacaucgccgacacgaccgacgcgguccgcgacccccagacccuggagauccucgacaucacccccugcuccuucgggggcgugagcgugaucacgccggggaccaacaccuccaaccaggucgccgugcuguaccaggacgugaacugcaccgagguccccguggccauccacgccgaccagcugacgcccaccuggcggguguacagcaccggcuccaacgucuuccagacccgcgccggcugccucaucggggcggagcacgugaacaacagcuacgagugcgacauccccaucggcgccgggaucugcgccuccuaccagacgcagaccaacagcccgcggcgcgcccgguccguggcgagccaguccaucaucgccuacaccaugagccugggcgccgagaacuccgucgccuacagcaacaacuccaucgccauccccaccaacuucacgaucagcgugaccaccgagauccugcccgugagcaugaccaagacguccgucgacugcaccauguacaucugcggcgacagcaccgagugcuccaaccuccugcugcaguacgggagcuucugcacccagcucaaccgcgcgcugacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggguucaucaagcaguacggcgacugccucggcgacaucgcggcccgcgaccugaucugcgcccagaaguucaacgggcugaccgugcucccgccccugcugaccgacgagaugaucgcccaguacaccuccgcccuccuggcgggcaccaucacgagcggguggaccuucggcgccggggccgcccugcagauccccuucgcgaugcagauggccuaccgguucaacggcaucggcgucacccagaacgugcucuacgagaaccagaagcugaucgccaaccaguucaacuccgccaucgggaagauccaggacagccuguccagcaccgccuccgcgcucggcaagcugcaggacguggucaaccagaacgcccaggcccugaacacgcucgugaagcagcugagcuccaacuucggggccaucagcuccgugcugaacgacauccucagccgccuggacaaggucgaggccgaggugcagaucgaccggcugaucaccggccgccuccagagccugcagaccuacgugacccagcagcugauccgggcggccgagauccgcgccuccgccaaccucgccgcgaccaagaugagcgagugcguccuggggcaguccaagcggguggacuucugcggcaagggcuaccaccugaugagcuucccccaguccgccccgcacgggguggucuuccuccacgugacguacguccccgcccaggagaagaacuucaccaccgcccccgcgaucugccacgacggcaaggcccacuucccccgcgaggggguguucgugagcaacggcacccacugguucgucacgcagcggaacuucuacgagccgcagaucaucaccaccgacaacaccuucguguccgggaacugcgacguggucaucggcaucgugaacaacacgguguacgacccccugcagcccgagcuggacagcuucaaggaggagcucgacaaguacuucaagaaccacaccucccccgacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggccgugguacaucuggcugggguucaucgccggccugaucgcgaucgugauggugaccaucaugcucugcugcaugaccuccugcugcagcugccugaagggcugcugcuccugcgggagcugcugcaaguucgacgaggacgacuccgagcccguccugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12784 - RNA, 4039 nt, Artificial Sequence
  SARS-CoV-2/Iceland/192/2020__EPI_ISL_417819 spike protein mRNA gc (1-1273)
aggagaaagcuuaccauguucguguucuucguccugcucccccuggugagcucccagugcgugaaccugaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcacguucgaguacgugagccagcccuuccucauggaccuggagggcaagcaggggaacuucaagaaccugcgcgaguucguguucaagaacaucgacggcuacuucaagaucuacuccaagcacaccccgaucaaccucguccgggaccugccccagggguucagcgcccuggagccccucguggaccugcccaucggcaucaacaucacccgcuuccagacccugcucgcccugcaccgguccuaccugacgccgggggacagcagcuccggcuggaccgcgggcgccgccgccuacuacgugggguaccuccagccccgcaccuuccugcugaaguacaacgagaacggcaccaucacggacgcggucgacugcgcccucgacccccugagcgagaccaagugcacccugaaguccuucaccguggagaaggggaucuaccagacgagcaacuuccgggugcagcccaccgaguccaucguccgcuucccgaacaucaccaaccucugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcugaacgaccucugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccuggacuccaaggucgggggcaacuacaacuaccucuaccgccuguuccgcaagagcaaccugaagcccuucgagcgggacaucuccaccgagaucuaccaggccggcagcacccccugcaacgggguggagggcuucaacugcuacuucccccuccaguccuacggguuccagccgaccaacggcgugggguaccagcccuaccggguggucgugcugagcuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgcgacccccagacccuggagauccuggacaucacccccugcagcuucggcgggguguccgugaucacgccgggcaccaacaccagcaaccaggucgccgugcucuaccagggcgugaacugcaccgagguccccguggccauccacgccgaccagcugacgcccaccuggcggguguacuccaccgggagcaacgucuuccagacccgcgccggcugccugaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccucggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccugcuccugcaguacggguccuucugcacccagcugaaccgcgcgcucacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccugggcgacaucgcggcccgcgaccucaucugcgcccagaaguucaacgggcugaccgugcugccgccccuccugaccgacgagaugaucgcccaguacaccagcgcccugcucgcgggcaccaucacguccggguggaccuucggcgccggcgccgcccugcagauccccuucgcgaugcagauggccuaccgguucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugucccgccucgacaaggucgaggccgaggugcagaucgaccggcugaucaccggccgccugcagagccuccagaccuacgugacccagcagcugauccgggcggccgagauccgcgccagcgccaaccuggccgcgaccaagauguccgagugcguccucggccagagcaagcggguggacuucugcgggaagggcuaccaccugauguccuucccccagagcgccccgcacgggguggucuuccugcacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccuccagcccgagcuggacuccuucaaggaggagcuggacaaguacuucaagaaccacaccagccccgacgucgaccucggcgacaucuccgggaucaacgccagcguggugaacauccagaaggagaucgaccgccugaacgaggucgccaagaaccugaacgagucccucaucgaccugcaggagcugggcaaguacgagcaguacaucaaguggccgugguacaucuggcucggcuucaucgccgggcugaucgcgaucgugauggugaccaucaugcugugcugcaugaccagcugcugcuccugccucaagggcugcugcagcugcggguccugcugcaaguucgacgaggacgacagcgagcccguccugaagggcgugaagcugcacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12785 - RNA, 4039 nt, Artificial Sequence
  SARS-CoV-2/Belgium/ULG-6939/2020__EPI_ISL_417020 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucguguacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcccugacgggcaucgcgguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccagcgcccuccuggccggcaccaucacguccggguggaccuucggcgcgggcgccgcccugcagauccccuucgccaugcagauggcguaccgguucaacgggaucggcgugacccagaacgugcucuacgagaaccagaagcugaucgccaaccaguucaacagcgccaucgggaagauccaggacucccugagcuccaccgccagcgcccucggcaagcugcaggacgucgugaaccagaacgcgcaggcccugaacacgcucgugaagcagcuguccagcaacuucggggccaucuccagcguccugaacgacauccucucccgccuggacaagguggaggccgaggugcagaucgaccggcugaucaccggccgccuccagagccugcagaccuacgucacccagcagcugauccgggccgcggagauccgcgccagcgccaaccucgccgccaccaagauguccgagugcgugcugggccagagcaagcggguggacuucugcgggaagggcuaccaccugauguccuucccccagagcgcgccgcacggggucguguuccuccacgucacguacgugcccgcccaggagaagaacuucaccaccgcccccgccaucugccacgacggcaaggcgcacuucccccgcgaggggguguucgucuccaacggcacccacugguucgugacgcagcggaacuucuacgagccgcagaucaucaccaccgacaacaccuucgugagcggcaacugcgacgucgugaucgggaucgugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgccaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12786 - RNA, 4039 nt, Artificial Sequence
  SARS-CoV-2/France/HF2496/2020__EPI_ISL_418231 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucguggcgcgcgaccugaucugcgcccagaaguucaacgggcugaccguccucccgccccugcugaccgacgagaugaucgcccaguacaccagcgcccuccuggccggcaccaucacguccggguggaccuucggcgcgggcgccgcccugcagauccccuucgccaugcagauggcguaccgguucaacgggaucggcgugacccagaacgugcucuacgagaaccagaagcugaucgccaaccaguucaacagcgccaucgggaagauccaggacucccugagcuccaccgccagcgcccucggcaagcugcaggacgucgugaaccagaacgcgcaggcccugaacacgcucgugaagcagcuguccagcaacuucggggccaucuccagcguccugaacgacauccucucccgccuggacaagguggaggccgaggugcagaucgaccggcugaucaccggccgccuccagagccugcagaccuacgucacccagcagcugauccgggccgcggagauccgcgccagcgccaaccucgccgccaccaagauguccgagugcgugcugggccagagcaagcggguggacuucugcgggaagggcuaccaccugauguccuucccccagagcgcgccgcacggggucguguuccuccacgucacguacgugcccgcccaggagaagaacuucaccaccgcccccgccaucugccacgacggcaaggcgcacuucccccgcgaggggguguucgucuccaacggcacccacugguucgugacgcagcggaacuucuacgagccgcagaucaucaccaccgacaacaccuucgugagcggcaacugcgacgucgugaucgggaucgugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgccaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12787 - RNA, 4039 nt, Artificial Sequence
  SARS-CoV-2/USA/WA-UW291/2020__EPI_ISL_418076 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaguacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12788 - RNA, 4039 nt, Artificial Sequence
  SARS-CoV-2/Portugal/PT0034/2020__EPI_ISL_418019 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaucaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12789 - RNA, 4039 nt, Artificial Sequence
  SARS-CoV-2/Iceland/202/2020__EPI_ISL_417750 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucccgggcaucaacgccuccguggugaacauccagaaggagaucgaccgccugaacgaggucgccaagaaccucaacgagagccugaucgaccugcaggagcucgggaaguacgagcaguacaucaaguggcccugguacaucuggcugggcuucaucgccggccugaucgcgaucgugauggugaccaucaugcucugcugcaugaccuccugcugcagcugccugaaggggugcugcuccugcggcagcugcugcaaguucgacgaggacgacuccgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12790 - RNA, 4039 nt, Artificial Sequence
  SARS-CoV-2/USA/WA-UW261/2020__EPI_ISL_418046 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucacgagcgucuacgccuggaaccgcaagcggaucuccaacugcguggccgacuacagcgugcuguacaacuccgcgagcuucuccaccuucaagugcuacggcgucagccccaccaagcucaacgaccugugcuucaccaacguguacgccgacuccuucgugauccgcggggacgagguccggcagaucgcccccggccagacggggaagaucgccgacuacaacuacaagcugccggacgacuucaccggcugcgugaucgccuggaacagcaacaaccucgacuccaaggucgggggcaacuacaacuaccuguaccgccuguuccgcaagagcaaccucaagcccuucgagcgggacaucuccaccgagaucuaccaggcgggcagcacccccugcaacgggguggagggcuucaacugcuacuucccccugcaguccuacggguuccagccgacgaacggcgugggguaccagcccuaccggguggucgugcugagcuucgagcuccugcacgcccccgccaccgugugcggccccaagaaguccaccaaccuggucaagaacaagugcgugaacuucaacuucaacggccucaccgggaccggcgugcugacggagagcaacaagaaguuccugccguuccagcaguucgggcgcgacaucgccgacaccaccgacgccguccgcgacccccagacccuggagauccucgacaucacgcccugcagcuucggcgggguguccgugaucaccccgggcaccaacaccagcaaccaggucgcggugcuguaccaggacgugaacugcacggagguccccguggccauccacgccgaccagcugacccccaccuggcggguguacuccaccggcagcaacgucuuccagacgcgcgccgggugccucaucggcgccgagcacgugaacaacuccuacgagugcgacauccccaucggggcgggcaucugcgccagcuaccagacccagaccaacuccccgcggcgcgcccggagcguggccucccagagcaucaucgcguacaccaugucccugggcgccgagaacagcgucgccuacuccaacaacagcaucgccauccccacgaacuucaccaucuccgugaccaccgagauccugcccgugagcaugacgaagaccagcgucgacugcaccauguacaucugcggggacuccaccgagugcagcaaccuccugcugcaguacggcuccuucugcacgcagcucaaccgcgcccugaccgggaucgcgguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgccgcgcgcgaccugaucugcgcccagaaguucaacggccugaccgugcucccgccccugcugaccgacgagaugaucgcccaguacaccagcgcccuccuggccgggacgaucaccuccggcuggaccuucggggcgggcgccgcccugcagauccccuucgccaugcagauggcguaccgguucaacggcaucggggucacccagaacgugcucuacgagaaccagaagcugaucgccaaccaguucaacagcgccaucggcaagauccaggacucccugagcuccacggccagcgcccucgggaagcugcaggacguggucaaccagaacgcgcaggcccugaacacccucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggccgcggagauccgcgccagcgccaaccucgccgccacgaagauguccgagugcguccugggccagagcaagcggguggacuucugcggcaagggguaccaccugauguccuucccccagagcgcgccgcacggcguggucuuccuccacgugaccuacguccccgcccaggagaagaacuucaccaccgcccccgccaucugccacgacgggaaggcgcacuucccccgcgagggcguguucguguccaacgggacgcacugguucgucacccagcggaacuucuacgagccgcagaucaucaccaccgacaacacguucgugagcggcaacugcgacguggucaucggcaucgugaacaacaccguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgccaucgugauggugaccaucaugcucugcugcaugacgagcugcugcuccugccugaaggggugcugcagcugcggcuccugcugcaaguucgacgaggacgacagcgagcccguccugaagggggugaagcuccacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12791 - RNA, 4039 nt, Artificial Sequence
  SARS-CoV-2/Portugal/PT0035/2020__EPI_ISL_418020 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucagcgcgcgcgaccugaucugcgcccagaaguucaacggccugaccgugcucccgccccugcugaccgacgagaugaucgcccaguacaccuccgcccuccuggccgggaccaucacgagcggcuggaccuucggggcgggcgccgcccugcagauccccuucgccaugcagauggcguaccgguucaacggcaucggggucacccagaacgugcucuacgagaaccagaagcugaucgccaaccaguucaacuccgccaucggcaagauccaggacagccuguccagcaccgccuccgcccucgggaagcugcaggacguggucaaccagaacgcgcaggcccugaacacgcucgugaagcagcugagcuccaacuucggcgccaucagcuccgugcugaacgacauccucagccgccuggacaaggucgaggccgaggugcagaucgaccggcugaucaccgggcgccuccagagccugcagaccuacgugacccagcagcugauccgggccgcggagauccgcgccuccgccaaccucgccgccaccaagaugagcgagugcguccugggccaguccaagcggguggacuucugcggcaagggguaccaccugaugagcuucccccaguccgcgccgcacggcguggucuuccuccacgugacguacguccccgcccaggagaagaacuucaccaccgcccccgccaucugccacgacgggaaggcgcacuucccccgcgagggcguguucgugagcaacgggacccacugguucgucacgcagcggaacuucuacgagccgcagaucaucaccaccgacaacaccuucguguccggcaacugcgacguggucaucggcaucgugaacaacacgguguacgacccccugcagcccgagcuggacagcuucaaggaggagcucgacaaguacuucaagaaccacaccucccccgacgucgaccugggggacaucagcggcaucaacgccuccguggugaacauccagaaggagaucgaccgccugaacgaggucgccaagaaccucaacgagagccugaucgaccugcaggagcucgggaaguacgagcaguacaucaaguggccgugguacaucuggcugggcuucaucgccggccugaucgccaucgugauggugaccaucaugcucugcugcaugaccuccugcugcagcugccugaaggggugcugcuccugcggcagcugcugcaaguucgacgaggacgacuccgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12792 - RNA, 4039 nt, Artificial Sequence
  SARS-CoV-2/USA/NY-NYUMC7/2020__EPI_ISL_418192 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12793 - RNA, 4039 nt, Artificial Sequence
  SARS-CoV-2/Iceland/189/2020__EPI_ISL_417709 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaccaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcacgaucaccuccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccacggccagcgcgcucggcaagcugcaggacguggucaaccagaacgcccaggcccugaacacccucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgacgaagauguccgagugcguccugggccagagcaagcggguggacuucugcgggaagggcuaccaccugauguccuucccccagagcgccccgcacgggguggucuuccuccacgugaccuacguccccgcccaggagaagaacuucaccaccgcccccgcgaucugccacgacggcaaggcccacuucccccgcgaggggguguucguguccaacggcacgcacugguucgucacccagcggaacuucuacgagccgcagaucaucaccaccgacaacacguucgugagcggcaacugcgacguggucaucgggaucgugaacaacaccguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugacgagcugcugcuccugccugaagggcugcugcagcugcggguccugcugcaaguucgacgaggacgacagcgagcccguccugaagggcgugaagcuccacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12794 - RNA, 4039 nt, Artificial Sequence
  SARS-CoV-2/Australia/NSW56/2020__EPI_ISL_417408 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgacuccagcaagcccuccaagcggagcuucaucgaggaccuccuguucaacaaggugacccuggccgacgccggcuucaucaagcaguacggcgacugccucggggacaucgcggcccgcgaccugaucugcgcccagaaguucaacggccugaccgugcugcccccgcuccugaccgacgagaugaucgcccaguacaccuccgcccuccuggcggggaccaucacgagcggcuggaccuucggggccggcgccgcccugcagauccccuucgcgaugcagauggccuaccgguucaacggcaucggggucacccagaacgugcucuacgagaaccagaagcugaucgccaaccaguucaacuccgccaucggcaagauccaggacagccuguccagcaccgccuccgcgcucgggaagcugcaggacguggucaaccagaacgcccaggcccugaacacgcucgugaagcagcugagcuccaacuucggcgccaucagcuccgugcugaacgacauccucagccgccuggacaaggucgaggccgaggugcagaucgaccggcugaucaccgggcgccuccagagccugcagaccuacgugacccagcagcugauccgggcggccgagauccgcgccuccgccaaccucgccgcgaccaagaugagcgagugcguccugggccaguccaagcggguggacuucugcggcaagggguaccaccugaugagcuucccccaguccgcgccccacggcguggucuuccuccacgugacguacgucccggcccaggagaagaacuucaccaccgcccccgccaucugccacgacgggaaggcccacuucccccgcgagggcguguucgugagcaacgggacccacugguucgucacgcagcggaacuucuacgagccccagaucaucaccaccgacaacaccuucguguccggcaacugcgacguggucaucggcaucgugaacaacacgguguacgacccgcugcagcccgagcuggacagcuucaaggaggagcucgacaaguacuucaagaaccacaccucccccgacgucgaccugggggacaucagcggcaucaacgccuccguggugaacauccagaaggagaucgaccgccugaacgaggucgccaagaaccucaacgagagccugaucgaccugcaggagcucgggaaguacgagcaguacaucaaguggcccugguacaucuggcugggcuucaucgccggccugaucgcgaucgugauggugaccaucaugcucugcugcaugaccuccugcugcagcugccugaaggggugcugcuccugcggcagcugcugcaaguucgacgaggacgacuccgagccgguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12795 - RNA, 4039 nt, Artificial Sequence
  SARS-CoV-2/Iceland/280/2020__EPI_ISL_417608 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccacacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12796 - RNA, 4039 nt, Artificial Sequence
  SARS-CoV-2/Iceland/247/2020__EPI_ISL_417575 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugaucgugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12797 - RNA, 4039 nt, Artificial Sequence
  SARS-CoV-2/Iceland/238/2020__EPI_ISL_417566 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgugggcuucaucaagcaguacggggacugccucggcgacaucgccgcgcgcgaccugaucugcgcccagaaguucaacgggcugaccguccucccgccccugcugaccgacgagaugaucgcccaguacaccagcgcccuccuggccggcaccaucacguccggguggaccuucggcgcgggcgccgcccugcagauccccuucgccaugcagauggcguaccgguucaacgggaucggcgugacccagaacgugcucuacgagaaccagaagcugaucgccaaccaguucaacagcgccaucgggaagauccaggacucccugagcuccaccgccagcgcccucggcaagcugcaggacgucgugaaccagaacgcgcaggcccugaacacgcucgugaagcagcuguccagcaacuucggggccaucuccagcguccugaacgacauccucucccgccuggacaagguggaggccgaggugcagaucgaccggcugaucaccggccgccuccagagccugcagaccuacgucacccagcagcugauccgggccgcggagauccgcgccagcgccaaccucgccgccaccaagauguccgagugcgugcugggccagagcaagcggguggacuucugcgggaagggcuaccaccugauguccuucccccagagcgcgccgcacggggucguguuccuccacgucacguacgugcccgcccaggagaagaacuucaccaccgcccccgccaucugccacgacggcaaggcgcacuucccccgcgaggggguguucgucuccaacggcacccacugguucgugacgcagcggaacuucuacgagccgcagaucaucaccaccgacaacaccuucgugagcggcaacugcgacgucgugaucgggaucgugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgccaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12798 - RNA, 4039 nt, Artificial Sequence
  SARS-CoV-2/Greece/16/2020__EPI_ISL_418265 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacgucgacggcuacuucaagaucuacuccaagcacaccccgaucaaccuggugcgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgucggguaccugcagccccgcaccuuccugcucaaguacaacgagaacggcaccaucacggacgcgguggacugcgcccuggacccccugagcgagaccaagugcacccucaaguccuucaccguggagaaggggaucuaccagacgagcaacuuccggguccagcccaccgaguccaucgugcgcuucccgaacaucaccaaccugugccccuucggcgaggucuucaacgccacccgguucgccagcguguacgccuggaaccgcaagcggaucuccaacugcguggcggacuacagcguccuguacaacuccgccagcuucuccacguucaagugcuacggcgugagccccaccaagcucaacgaccugugcuucaccaacguguacgccgacuccuucgucauccgcggggacgaggugcggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccgggucguggugcugagcuucgagcuccugcacgcccccgccacggucugcggccccaagaaguccaccaaccuggugaagaacaagugcgugaacuucaacuucaacggccucaccgggaccggcguccugaccgagagcaacaagaaguuccugccguuccagcaguucgggcgcgacaucgccgacacgaccgacgcggugcgcgacccccagacccuggagauccucgacaucacccccugcagcuucggcgggguguccgucaucacgccgggcaccaacaccagcaaccagguggccgugcuguaccaggacgucaacugcaccgaggugcccguggccauccacgccgaccagcugacgcccaccuggcgggucuacuccaccggcagcaacguguuccagacccgcgccgggugccucaucggcgcggagcacgugaacaacuccuacgagugcgacauccccaucggggccggcaucugcgccagcuaccagacgcagaccaacuccccgcggcgcgcccggagcgucgcgucccagagcaucaucgccuacaccaugucccugggcgccgagaacagcguggccuacuccaacaacagcaucgccauccccaccaacuucacgaucuccgugaccaccgagauccugcccgucagcaugaccaagacgagcguggacugcaccauguacaucugcggggacuccaccgagugcagcaaccuccugcugcaguacggcuccuucugcacccagcucaaccgcgcgcugacggggaucgccguggagcaggacaagaacacccaggaggucuucgcccaggugaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccguccucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggugacccagaacgugcucuacgagaaccagaagcugaucgccaaccaguucaacagcgccaucggcaagauccaggacucccugagcuccaccgccagcgcgcucgggaagcugcaggacgucgugaaccagaacgcccaggcccugaacacgcucgugaagcagcuguccagcaacuucggcgccaucuccagcguccugaacgacauccucucccgccuggacaagguggaggccgaggugcagaucgaccggcugaucaccgggcgccuccagagccugcagaccuacgucacccagcagcugauccgggcggccgagauccgcgccagcgccaaccucgccgcgaccaagauguccgagugcgugcugggccagagcaagcggguggacuucugcggcaagggguaccaccugauguccuucccccagagcgccccgcacggcgucguguuccuccacgucacguacgugcccgcccaggagaagaacuucaccaccgcccccgcgaucugccacgacgggaaggcccacuucccccgcgagggcguguucgucuccaacgggacccacugguucgugacgcagcggaacuucuacgagccgcagaucaucaccaccgacaacaccuucgugagcggcaacugcgacgucgugaucggcaucgugaacaacacggucuacgacccccugcagcccgagcuggacuccuucaaggaggagcucgacaaguacuucaagaaccacaccagccccgacguggaccugggggacaucuccggcaucaacgccagcguggucaacauccagaaggagaucgaccgccugaacgagguggccaagaaccucaacgagucccugaucgaccugcaggagcucgggaaguacgagcaguacaucaaguggccgugguacaucuggcugggcuucaucgccggccugaucgcgaucgugauggucaccaucaugcucugcugcaugaccagcugcugcuccugccugaaggggugcugcagcugcggcuccugcugcaaguucgacgaggacgacagcgagcccgugcugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12799 - RNA, 4039 nt, Artificial Sequence
  SARS-CoV-2/Iceland/319/2020__EPI_ISL_417648 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugaucgaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12800 - RNA, 4039 nt, Artificial Sequence
  SARS-CoV-2/Congo/94/2020__EPI_ISL_417947 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggacauccucuucaacaaggugacccuggccgacgccggcuucaucaagcaguacggggacugccugggcgacaucgcggcccgcgaccucaucugcgcccagaaguucaacgggcugaccgugcugccgccccuccugaccgacgagaugaucgcccaguacaccagcgcccugcucgcgggcaccaucacguccggguggaccuucggcgccggcgccgcccugcagauccccuucgcgaugcagauggccuaccgguucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugucccgccucgacaaggucgaggccgaggugcagaucgaccggcugaucaccggccgccugcagagccuccagaccuacgugacccagcagcugauccgggcggccgagauccgcgccagcgccaaccuggccgcgaccaagauguccgagugcguccucggccagagcaagcggguggacuucugcgggaagggcuaccaccugauguccuucccccagagcgccccgcacgggguggucuuccugcacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccuccagcccgagcuggacuccuucaaggaggagcuggacaaguacuucaagaaccacaccagccccgacgucgaccucggcgacaucuccgggaucaacgccagcguggugaacauccagaaggagaucgaccgccugaacgaggucgccaagaaccugaacgagucccucaucgaccugcaggagcugggcaaguacgagcaguacaucaaguggccgugguacaucuggcucggcuucaucgccgggcugaucgcgaucgugauggugaccaucaugcugugcugcaugaccagcugcugcuccugccucaagggcugcugcagcugcggguccugcugcaaguucgacgaggacgacagcgagcccguccugaagggcgugaagcugcacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12801 - RNA, 4039 nt, Artificial Sequence
  SARS-CoV-2/Congo/158/2020__EPI_ISL_417950 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuuccugagcggcaacugcgacguggugaucggcaucgucaacaacacgguguacgacccccugcagcccgagcucgacuccuucaaggaggagcuggacaaguacuucaagaaccacaccagccccgacguggaccugggggacaucuccggcaucaacgccagcgucgugaacauccagaaggagaucgaccgccucaacgagguggccaagaaccugaacgagucccugaucgaccuccaggagcuggggaaguacgagcaguacaucaaguggccgugguacaucuggcugggcuucaucgccggccucaucgcgaucgucauggugaccaucaugcugugcugcaugaccagcugcugcuccugccugaaggggugcugcagcugcggcuccugcugcaaguucgacgaggacgacagcgagcccgugcucaagggggucaagcugcacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12802 - RNA, 4039 nt, Artificial Sequence
  SARS-CoV-2/USA/UT-00034/2020__EPI_ISL_417977 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuacuacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12803 - RNA, 4039 nt, Artificial Sequence
  SARS-CoV-2/USA/UT-00033/2020__EPI_ISL_417976 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggccugaccgcgggcgccgccgccuacuacgugggguaccugcagccccgcaccuuccuccugaaguacaacgagaacggcaccaucacggacgcggucgacugcgcccuggacccccucagcgagaccaagugcacccugaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcucuacaacuccgccagcuucuccacguucaagugcuacggcgucagccccaccaagcugaacgaccugugcuucaccaacguguacgccgacuccuucgugauccgcggggacgagguccggcagaucgcccccggccagaccgggaagaucgccgacuacaacuacaagcucccggacgacuucacgggcugcgugaucgcguggaacagcaacaaccuggacuccaaggucgggggcaacuacaacuaccuguaccgccucuuccgcaagagcaaccugaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcucagcuucgagcugcugcacgcccccgccacggugugcggccccaagaaguccaccaaccucgucaagaacaagugcgugaacuucaacuucaacggccugaccgggaccggcgugcugaccgagagcaacaagaaguuccugccguuccagcaguucgggcgcgacaucgccgacacgaccgacgcgguccgcgacccccagacccucgagauccuggacaucacccccugcagcuucggcgggguguccgugaucacgccgggcaccaacaccagcaaccaggucgccgugcuguaccagggcgugaacugcaccgagguccccguggccauccacgccgaccagcucacgcccaccuggcggguguacuccaccgggagcaacgucuuccagacccgcgccggcugccugaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccuccccgugagcaugaccaagacgagcgucgacugcaccauguacaucugcggcgacuccaccgagugcagcaaccugcugcuccaguacggguccuucugcacccagcugaaccgcgcgcugacgggcaucgccguggagcaggacaagaacacccaggagguguucgcccaggucaagcagaucuacaagacgcccccgaucaaggacuucgggggcuucaacuucagccagauccuccccgaccccuccaagcccagcaagcgguccuucaucgaggaccugcuguucaacaaggugacccucgccgacgccggcuucaucaagcaguacggggacugccugggcgacaucgcggcccgcgaccugaucugcgcccagaaguucaacgggcucaccgugcugccgccccugcucaccgacgagaugaucgcccaguacaccagcgcccugcuggcgggcaccaucacguccggguggaccuucggcgccggcgccgcccuccagauccccuucgcgaugcagauggccuaccgguucaacgggaucggcgucacccagaacgugcuguacgagaaccagaagcugaucgccaaccaguucaacagcgccaucgggaagauccaggacucccucagcuccaccgccagcgcgcugggcaagcugcaggacguggucaaccagaacgcccaggcccucaacacgcuggugaagcagcuguccagcaacuucggggccaucuccagcgugcucaacgacauccugucccgccuggacaaggucgaggccgaggugcagaucgaccggcucaucaccggccgccugcagagccugcagaccuacgugacccagcagcucauccgggcggccgagauccgcgccagcgccaaccuggccgcgaccaagauguccgagugcguccugggccagagcaagcggguggacuucugcgggaagggcuaccaccucauguccuucccccagagcgccccgcacgggguggucuuccugcacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcucgacuccuucaaggaggagcuggacaaguacuucaagaaccacaccagccccgacgucgaccugggcgacaucuccgggaucaacgccagcguggugaacauccagaaggagaucgaccgccucaacgaggucgccaagaaccugaacgagucccugaucgaccuccaggagcugggcaaguacgagcaguacaucaaguggccgugguacaucuggcugggcuucaucgccgggcucaucgcgaucgugauggugaccaucaugcugugcugcaugaccagcugcugcuccugccugaagggcugcugcagcugcggguccugcugcaaguucgacgaggacgacagcgagcccguccucaagggcgugaagcugcacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12804 - RNA, 4039 nt, Artificial Sequence
  SARS-CoV-2/USA/WI-13/2020__EPI_ISL_417516 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcugcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcucuacaacuccgccagcuucuccacguucaagugcuacggcgucagccccaccaagcugaacgaccugugcuucaccaacguguacgccgacuccuucgugauccgcggggacgagguccggcagaucgcccccggccagaccgggaagaucgccgacuacaacuacaagcucccggacgacuucacgggcugcgugaucgcguggaacagcaacaaccuggacuccaaggucgggggcaacuacaacuaccuguaccgccucuuccgcaagagcaaccugaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcucagcuucgagcugcugcacgcccccgccacggugugcggccccaagaaguccaccaaccucgucaagaacaagugcgugaacuucaacuucaacggccugaccgggaccggcgugcugaccgagagcaacaagaaguuccugccguuccagcaguucgggcgcgacaucgccgacacgaccgacgcgguccgcgacccccagacccucgagauccuggacaucacccccugcagcuucggcgggguguccgugaucacgccgggcaccaacaccagcaaccaggucgccgugcuguaccagggcgugaacugcaccgagguccccguggccauccacgccgaccagcucacgcccaccuggcggguguacuccaccgggagcaacgucuuccagacccgcgccggcugccugaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccuccccgugagcaugaccaagacgagcgucgacugcaccauguacaucugcggcgacuccaccgagugcagcaaccugcugcuccaguacggguccuucugcacccagcugaaccgcgcgcugacgggcaucgccguggagcaggacaagaacacccaggagguguucgcccaggucaagcagaucuacaagacgcccccgaucaaggacuucgggggcuucaacuucagccagauccuccccgaccccuccaagcccagcaagcgguccuucaucgaggaccugcuguucaacaaggugacccucgccgacgccggcuucaucaagcaguacggggacugccugggcgacaucgcggcccgcgaccugaucugcgcccagaaguucaacgggcucaccgugcugccgccccugcucaccgacgagaugaucgcccaguacaccagcgcccugcuggcgggcaccaucacguccggguggaccuucggcgccggcgccgcccuccagauccccuucgcgaugcagauggccuaccgguucaacgggaucggcgucacccagaacgugcuguacgagaaccagaagcugaucgccaaccaguucaacagcgccaucgggaagauccaggacucccucagcuccaccgccagcgcgcugggcaagcugcaggacguggucaaccagaacgcccaggcccucaacacgcuggugaagcagcuguccagcaacuucggggccaucuccagcgugcucaacgacauccugucccgccuggacaaggucgaggccgaggugcagaucgaccggcucaucaccggccgccugcagagccugcagaccuacgugacccagcagcucauccgggcggccgagauccgcgccagcgccaaccuggccgcgaccaagauguccgagugcguccugggccagagcaagcggguggacuucugcgggaagggcuaccaccucauguccuucccccagagcgccccgcacgggguggucuuccugcacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcucgacuccuucaaggaggagcuggacaaguacuucaagaaccacaccagccccgacgucgaccugggcgacaucuccgggaucaacgccagcguggugaacauccagaaggagaucgaccgccucaacgaggucgccaagaaccugaacgagucccugaucgaccuccaggagcugggcaaguacgagcaguacaucaaguggccgugguacaucuggcugggcuucaucgccgggcucaucgcgaucgugauggugaccaucaugcugugcugcaugaccagcugcugcuccugccugaagggcugcugcagcugcggguccugcugcaaguucgacgaggacgacagcgagcccguccucaagggcgugaagcugcacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12805 - RNA, 4036 nt, Artificial Sequence
  SARS-CoV-2/India/1-27/2020__EPI_ISL_413522 spike protein mRNA gc (1-1272)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgaggucauccagaucgcccccggccagaccgggaagaucgccgacuacaacuacaagcugccggacgacuucacgggcugcgugaucgcguggaacagcaacaaccucgacuccaaggucgggggcaacuacaacuaccuguaccggcuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccgcguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgggacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcgcguguacuccaccggcagcaacgucuuccagacccgggccgggugccucaucggcgcggagcacgugaacaacuccuacgagugcgacauccccaucggggccggcaucugcgccagcuaccagacgcagaccaacuccccgcgccgggcccgcagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgggcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgcuccuucaucgaggaccuccuguucaacaaggugacccuggccgacgccggcuucaucaagcaguacggcgacugccucggggacaucgcggcccgggaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgcuucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccggcuggacaaggucgaggccgaggugcagaucgaccgccugaucaccgggcggcuccagagccugcagaccuacgugacccagcagcugauccgcgcggccgagauccgggccagcgccaaccucgccgcgaccaagauguccgagugcguccugggccagagcaagcgcguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgggagggcguguucguguccaacgggacccacugguucgucacgcagcgcaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccggcugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12806 - RNA, 4021 nt, Artificial Sequence
  SARS-CoV-2/pangolin/Guangxi/P4L/2017__EPI_ISL_410538 spike protein mRNA gc (1-1267)
aggagaaagcuuaccauguucguguuccuguucguccucccccuggugagcucccagugcgugaaccugaccacccgcacgggcaucccgcccggguacaccaacagcuccacccggggcgucuacuaccccgacaagguguuccgcagcuccauccuccaccugacccaggaccuguuccuccccuucuucagcaacgugacgugguucaacaccaucaacuaccagggcggguucaagaaguucgacaacccgguccugcccuucaacgacgggguguacuucgccuccaccgagaaguccaacaucauccggggcuggaucuucggcaccacgcuggacgcccgcacccagagccuccugaucgugaacaacgcgaccaacgucgugaucaaggugugcgaguuccaguucugcaccgaccccuuccugggggucuacuaccacaacaacaacaagacguggguggagaacgaguuccggguguacagcuccgccaacaacugcaccuucgaguacaucagccagcccuuccucauggaccuggagggcaagcaggggaacuucaagaaccugcgcgaguucgucuucaagaacguggacggcuacuucaagaucuacuccaagcacaccccgaucgaccucgugcgggaccugccccgcggguucgccgcccuggagccccucgucgaccugcccaucggcaucaacaucacccgguuccagacgcugcucgcccugcaccgcagcuaccugaccccgggcaaccucgaguccggguggaccaccggcgcggccgccuacuacgugggguaccugcagcagcggacguuccugcucagcuacaaccagaacggcaccaucaccgacgccguggacugcucccuggacccccugagcgagaccaagugcacgcucaagucccugaccgucgagaagggcaucuaccagaccagcaacuuccgcgugcagcccaccaucagcaucgugcgguuccccaacaucacgaaccugugcccguucggggaggucuucaacgcguccaaguucgccagcguguacgccuggaaccgcaagcggaucuccaacugcgucgccgacuacagcgugcucuacaacuccaccagcuucuccaccuucaagugcuacggcgugagccccaccaagcugaacgaccugugcuucacgaacgucuacgccgacuccuucguggugaagggggacgagguccgccagaucgcgcccggccagaccggggugaucgccgacuacaacuacaagcuccccgacgacuucaccggcugcgugaucgccuggaacagcgucaagcaggacgcccugaccggcgggaacuacggcuaccuguaccgccucuuccggaaguccaagcugaagccguucgagcgggacaucagcacggagaucuaccaggccggguccacccccugcaacggccagguggggcugaacugcuacuacccccucgagcgcuacggcuuccaccccaccaccggcgugaacuaccagccguuccgggucguggugcugagcuucgagcugcucaacgggcccgcgaccgucugcggccccaagcuguccacgacccuggugaaggacaagugcgugaacuucaacuucaacgggcugaccggcaccgggguccucacgaccagcaagaagcaguuccugcccuuccagcaguucggccgcgacaucuccgacaccaccgacgccgugcgcgacccgcagacgcuggagauccucgacaucacccccugcagcuucggcgggguguccgucaucacccccggcaccaacacgagcaaccagguggccgugcuguaccaggacgucaacugcaccgaggugccgauggccauccacgccgagcagcugacccccgcguggcggguguacagcgccggggccaacgucuuccagacccgcgccggcugccucgugggcgccgagcacgugaacaacuccuacgagugcgacauccccgucggggcgggcaucugcgccagcuaccacuccaugagcucccugcggagcgugaaccagcgcuccaucaucgccuacacgaugagccugggggccgagaacuccguggcguacagcaacaacuccaucgccauccccaccaacuucaccaucagcgucaccacggagauccucccgguguccaugaccaagaccagcguggacugcaccauguacaucugcggcgacuccaucgagugcagcaaccugcugcuccaguacggguccuucugcacgcagcugaaccgggcccugaccggcaucgccgucgagcaggacaagaacacccaggagguguucgcccaggugaagcagaucuacaagaccccgcccaucaaggacuucggcggguucaacuucagccagauccuccccgaccccagcaagcccuccaagcgcagcuucaucgaggaccugcuguucaacaaggucacgcucgcggacgccggcuucaucaagcaguacggggacugccugggcgacaucgccgcccgggaccugaucugcgcccagaaguucaacgggcucaccgugcugccgccccugcucaccgacgagaugaucgcgcaguacaccuccgcccugcuggccggcacgaucaccagcggcuggaccuucggggccggcgccgcgcuccagauccccuucgccaugcagauggccuaccgcuucaacgggaucggcgugacccagaacguccuguacgagaaccagaagcugaucgccaaccaguucaacuccgcgaucgggaagauccaggacagccucuccagcacggccuccgcccugggcaagcugcaggacguggugaaccagaacgcccaggcccucaacacccuggucaagcagcugagcuccaacuucggcgcgaucagcuccgugcucaacgacauccugagccggcuggacaagguggaggccgagguccagaucgaccgccucaucaccgggcggcugcagucccugcagaccuacgugacccagcagcucauccgcgccgccgagauccgggccagcgcgaaccuggccgccacgaagauguccgagugcgugcugggccagagcaagcgcgucgacuucugcgggaagggcuaccaccucauguccuucccccagagcgcgccccacgggguggucuuccugcacgugaccuacgugcccgcccaggagaagaacuucaccaccgccccggccaucugccacgagggcaaggcccacuucccccgggagggcgucuucgugagcaacgggacgcacugguucaucacccagcgcaacuucuacgagccccagaucaucaccaccgacaacacguucguguccggcagcugcgacgucgugaucgggaucgugaacaacaccgucuacgacccccugcagccggagcucgacuccuucaaggaggagcuggacaaguacuucaagaaccacaccagccccgacguggaccugggcgacaucuccggcaucaacgccagcguggucaacauccagaaggagaucgaccggcucaacgagguggcgaagaaccugaacgagucccccaucgaccugcaggagcucgggaaguacgagcaguacaucaaguggcccugguacaucuggcugggcuucaucgccgggcugaucgccaucaucauggugaccaucaugcucugcugcaugacgagcugcugcuccugccugaagggcugcugcagcugcggguccugcugcaaguucgacgaggacgacagcgagccgguccugaagggcgugaagcuccacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12807 - RNA, 4021 nt, Artificial Sequence
  SARS-CoV-2/pangolin/Guangxi/P5L/2017__EPI_ISL_410540 spike protein mRNA gc (1-1267)
aggagaaagcuuaccauguucguguuccuguucguccucccccuggugagcucccagugcgugaaccugaccacccgcacgggcaucccgcccggguacaccaacagcuccacccggggcgucuacuaccccgacaagguguuccgcagcuccauccuccaccugacccaggaccuguuccuccccuucuucagcaacgugacgugguucaacaccaucaacuaccagggcggguucaagaaguucgacaacccgguccugcccuucaacgacgggguguacuucgccuccaccgagaaguccaacaucauccggggcuggaucuucggcaccacgcuggacgcccgcacccagagccuccugaucgugaacaacgcgaccaacgucgugaucaaggugugcgaguuccaguucugcaccgaccccuuccugggggucuacuaccacaacaacaacaagacguggguggagaacgaguuccggguguacagcuccgccaacaacugcaccuucgaguacaucagccagcccuuccucauggaccuggagggcaagcaggggaacuucaagaaccugcgcgaguucgucuucaagaacguggacggcuacuucaagaucuacuccaagcacaccccgaucgaccucgugcgggaccugccccgcggguucgccgcccuggagccccucgucgaccugcccaucggcaucaacaucacccgguuccagacgcugcucgcccugcaccgcagcuaccugaccccgggcaagcucgaguccggguggaccaccggcgcggccgccuacuacgugggguaccugcagcagcggacguuccugcucagcuacaaccagaacggcaccaucaccgacgccguggacugcucccuggacccccugagcgagaccaagugcacgcucaagucccugaccgucgagaagggcaucuaccagaccagcaacuuccgcgugcagcccaccaucagcaucgugcgguuccccaacaucacgaaccugugcccguucggggaggucuucaacgcguccaaguucgccagcguguacgccuggaaccgcaagcggaucuccaacugcgucgccgacuacagcgugcucuacaacuccaccagcuucuccaccuucaagugcuacggcgugagccccaccaagcugaacgaccugugcuucacgaacgucuacgccgacuccuucguggugaagggggacgagguccgccagaucgcgcccggccagaccggggugaucgccgacuacaacuacaagcuccccgacgacuucaccggcugcgugaucgccuggaacagcgucaagcaggacgcccugaccggcgggaacuacggcuaccuguaccgccucuuccggaaguccaagcugaagccguucgagcgggacaucagcacggagaucuaccaggccggguccacccccugcaacggccagguggggcugaacugcuacuacccccucgagcgcuacggcuuccaccccaccaccggcgugaacuaccagccguuccgggucguggugcugagcuucgagcugcucaacgggcccgcgaccgucugcggccccaagcuguccacgacccuggugaaggacaagugcgugaacuucaacuucaacgggcugaccggcaccgggguccucacgaccagcaagaagcaguuccugcccuuccagcaguucggccgcgacaucuccgacaccaccgacgccgugcgcgacccgcagacgcuggagauccucgacaucacccccugcagcuucggcgggguguccgucaucacccccggcaccaacacgagcaaccagguggccgugcuguaccaggacgucaacugcaccgaggugccgauggccauccacgccgagcagcugacccccgcguggcggguguacagcgccggggccaacgucuuccagacccgcgccggcugccucgugggcgccgagcacgugaacaacuccuacgagugcgacauccccgucggggcgggcaucugcgccagcuaccacuccaugagcuccuuccggagcgugaaccagcgcuccaucaucgccuacacgaugagccugggggccgagaacuccguggcguacagcaacaacuccaucgccauccccaccaacuucaccaucagcgucaccacggagauccugccgguguccaugaccaagaccagcguggacugcaccauguacaucugcggcgacuccaucgagugcagcaaccuccugcugcaguacggguccuucugcacgcagcucaaccgggcccugaccggcaucgccgucgagcaggacaagaacacccaggagguguucgcccaggugaagcagaucuacaagaccccgcccaucaaggacuucggcggguucaacuucagccagauccugcccgaccccagcaagcccuccaagcgcagcuucaucgaggaccuccuguucaacaaggucacgcuggcggacgccggcuucaucaagcaguacggggacugccucggcgacaucgccgcccgggaccugaucugcgcccagaaguucaacgggcugaccgugcucccgccccugcugaccgacgagaugaucgcgcaguacaccuccgcccuccuggccggcacgaucaccagcggcuggaccuucggggccggcgccgcgcugcagauccccuucgccaugcagauggccuaccgcuucaacgggaucggcgugacccagaacguccucuacgagaaccagaagcugaucgccaaccaguucaacuccgcgaucgggaagauccaggacagccuguccagcacggccuccgcccucggcaagcugcaggacguggugaaccagaacgcccaggcccugaacacccucgucaagcagcugagcuccaacuucggcgcgaucagcuccgugcugaacgacauccucagccggcuggacaagguggaggccgagguccagaucgaccgccugaucaccgggcggcuccagucccugcagaccuacgugacccagcagcugauccgcgccgccgagauccgggccagcgcgaaccucgccgccacgaagauguccgagugcgugcugggccagagcaagcgcgucgacuucugcgggaagggcuaccaccugauguccuucccccagagcgcgccccacgggguggucuuccuccacgugaccuacgugcccgcccaggagaagaacuucaccaccgccccggccaucugccacgagggcaaggcccacuucccccgggagggcgucuucgugagcaacgggacgcacugguucaucacccagcgcaacuucuacgagccccagaucaucaccaccgacaacacguucguguccggcagcugcgacgucgugaucgggaucgugaacaacaccgucuacgacccccugcagccggagcuggacuccuucaaggaggagcucgacaaguacuucaagaaccacaccagccccgacguggaccugggcgacaucuccggcaucaacgccagcguggucaacauccagaaggagaucgaccggcugaacgagguggcgaagaaccucaacgagucccugaucgaccugcaggagcucgggaaguacgagcaguacaucaaguggcccugguacaucuggcugggcuucaucgccgggcugaucgccaucaucauggugaccaucaugcucugcugcaugacgagcugcugcuccugccugaagggcugcugcagcugcggguccugcugcaaguucgacgaggacgacagcgagcccguccugaagggcgugaagcuccacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12808 - RNA, 4021 nt, Artificial Sequence
  SARS-CoV-2/pangolin/Guangxi/P5E/2017__EPI_ISL_410541 spike protein mRNA gc (1-1267)
aggagaaagcuuaccauguucguguuccuguucguccucccccuggugagcucccagugcgugaaccugaccacccgcacgggcaucccgcccggguacaccaacagcuccacccggggcgucuacuaccccgacaagguguuccgcagcuccauccuccaccugacccaggaccuguuccuccccuucuucagcaacgugacgugguucaacaccaucaccuaccagggcggguccaagaaguucgacaacccgguccugcccuucaacgacgggguguacuucgccagcaccgagaaguccaacaucauccggggcuggaucuucggcacgacccuggacgcccgcacccagagccuccugaucgugaacaacgcgaccaacgucgugaucaaggugugcgaguuccaguucugcacggaccccuuccugggggucuacuaccacaacaacaacaagaccuggguggagaacgaguuccggguguacuccagcgccaacaacugcaccuucgaguacaucucccagcccuuccucauggaccuggagggcaagcaggggaacuucaagaaccugcgcgaguucgucuucaagaacguggacggcuacuucaagaucuacagcaagcacaccccgaucgaccucgugcgggaccugccccgcggguucgccgcccuggagccccucgucgaccugcccaucggcaucaacaucacgcgguuccagacccugcucgcccugcaccgcuccuaccugaccccgggcaagcucgagagcggguggaccacgggcgcggccgccuacuacgugggguaccugcagcagcggaccuuccugcucuccuacaaccagaacggcaccaucaccgacgccguggacugcagccuggacccccuguccgagacgaagugcacccucaagagccugaccgucgagaagggcaucuaccagaccagcaacuuccgcgugcagcccacgaucuccaucgugcgguuccccaacaucaccaaccugugcccguucggggaggucuucaacgcgagcaaguucgccuccguguacgccuggaaccgcaagcggaucagcaacugcgucgccgacuacuccgugcucuacaacagcaccuccuucagcaccuucaagugcuacggcgugucccccacgaagcugaacgaccugugcuucaccaacgucuacgccgacagcuucguggugaagggggacgagguccgccagaucgcgcccggccagaccggggugaucgccgacuacaacuacaagcuccccgacgacuucaccggcugcgugaucgccuggaacuccgucaagcaggacgcccugacgggcgacaacuacggguaccuguaccggcuguuccgcaagagcaagcucaagccguucgagcgggacaucuccaccgagaucuaccaggccggcagcacccccugcaacggccagguggggcugaacugcuacuacccccucgagcgcuacggguuccaccccaccaccggcgugaacuaccagccguuccgggucguggugcuguccuucgagcugcucaacggccccgcgacggucugcgggcccaagcugagcaccacccuggugaaggacaagugcgugaacuucaacuucaacggccugaccgggacgggcguccucaccaccuccaagaagcaguuccugcccuuccagcaguucgggcgcgacaucagcgacaccacggacgccgugcgcgacccgcagacccuggagauccucgacaucacccccugcuccuucggcggcgugagcgucaucacccccgggacgaacaccagcaaccagguggccgugcuguaccaggacgucaacugcaccgaggugccgauggccauccacgccgagcagcugacccccgcguggcggguguacuccgccggcgccaacgucuuccagacgcgcgccgggugccucgugggcgccgagcacgugaacaacagcuacgagugcgacauccccgucggcgcggggaucugcgccuccuaccacagcauguccagcuuccgguccgugaaccagcgcagcaucaucgccuacaccaugucccugggcgccgagaacagcguggcguacuccaacaacagcaucgccauccccaccaacuucaccaucuccgucacgaccgagauccugccggugagcaugaccaagaccuccguggacugcacgauguacaucugcggggacagcaucgagugcuccaaccuccugcugcaguacggcagcuucugcacccagcucaaccgggcccugaccgggaucgccgucgagcaggacaagaacacccaggagguguucgcccaggugaagcagaucuacaagacgccgcccaucaaggacuucggcggcuucaacuucagccagauccugcccgaccccuccaagcccagcaagcgcuccuucaucgaggaccuccuguucaacaaggucacccuggcggacgccggguucaucaagcaguacggcgacugccucggggacaucgccgcccgggaccugaucugcgcccagaaguucaacggccugaccgugcucccgccccugcugaccgacgagaugaucgcgcaguacacgagcgcccuccuggccgggaccaucaccuccggcuggaccuucggcgccggggccgcgcugcagauccccuucgccaugcagauggccuaccgcuucaacggcaucggggugacgcagaacguccucuacgagaaccagaagcugaucgccaaccaguucaacagcgcgaucggcaagauccaggacucccugagcuccaccgccagcgcccucgggaagcugcaggacguggugaaccagaacgcccaggcccugaacacccucgucaagcagcuguccagcaacuucggcgcgaucuccagcgugcugaacgacauccucucccggcuggacaagguggaggccgagguccagaucgaccgccugaucaccggccggcuccagagccugcagaccuacgugacgcagcagcugauccgcgccgccgagauccgggccuccgcgaaccucgccgccaccaagaugagcgagugcgugcuggggcaguccaagcgcgucgacuucugcggcaagggguaccaccugaugagcuucccccagagcgcgccccacggcguggucuuccuccacgugaccuacgugcccgcccaggagaagaacuucaccacggccccggccaucugccacgaggggaaggcccacuucccccgggagggcgucuucguguccaacggcacccacugguucaucacccagcgcaacuucuacgagccccagaucaucaccacggacaacaccuucgugagcggguccugcgacgucgugaucggcaucgugaacaacaccgucuacgacccccugcagccggagcuggacagcuucaaggaggagcucgacaaguacuucaagaaccacaccucccccgacguggaccugggggacaucagcggcaucaacgccuccguggucaacauccagaaggagaucgaccggcugaacgagguggcgaagaaccucaacgagagccugaucgaccugcaggagcucggcaaguacgagcaguacaucaaguggcccugguacaucuggcugggguucaucgccggccugaucgccaucaucauggugacgaucaugcucugcugcaugaccuccugcugcagcugccugaaggggugcugcuccugcggcagcugcugcaaguucgacgaggacgacuccgagcccguccugaagggggugaagcuccacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12809 - RNA, 4015 nt, Artificial Sequence
  SARS-CoV-2/pangolin/Guangxi/P1E/2017__EPI_ISL_410539 spike protein mRNA gc (1-1265)
aggagaaagcuuaccauguucguguuccuguucguccucccccuggugagcucccagugcgugaaccugaccacccgcacgggcauccagccgggguacaccaacagcuccacccggggcgucuacuaccccgacaagguguuccgcagcuccauccuccaccugacccaggaccuguuccuccccuucuucagcaacgugacgugguucaacaccaucaacuaccagggcggguucaagaaguucgacaaccccguccugccguucaacgacgggguguacuucgccuccaccgagaaguccaacaucauccggggcuggaucuucggcaccacgcuggacgcccgcacccagagccuccugaucgugaacaacgcgaccaacgucgugaucaaggugugcgaguuccaguucugcaccgaccccuuccugggggucuacuaccacaacaacaacaagacguggguggagaacgaguuccggguguacagcuccgccaacaacugcaccuucgaguacaucagccagcccuuccucauggaccuggagggcaagcaggggaacuucaagaaccugcgcgaguucgucuucaagaacguggacggcuacuucaagaucuacuccaagcacacccccaucgaccucgugcgggaccugccgcgcggguucgccgcccuggagccccucgucgaccugcccaucggcaucaacaucacccgguuccagacgcugcucgcccugcaccgcagcuaccugacccccggcaagcucgaguccggguggaccaccggcgcggccgccuacuacgugggguaccugcagcagcggacguuccugcucagcuacaaccagaacggcaccaucaccgacgccguggacugcucccuggacccgcugagcgagaccaagugcacgcucaagucccugaccgucgagaagggcaucuaccagaccagcaacuuccgcgugcagcccaccaucagcaucgugcgguuccccaacaucacgaaccugugccccuucggggaggucuucaacgcguccaaguucgccagcguguacgccuggaaccgcaagcggaucuccaacugcgucgccgacuacagcgugcucuacaacuccaccagcuucuccaccuucaagugcuacggcgugagcccgaccaagcugaacgaccugugcuucacgaacgucuacgccgacuccuucguggugaagggggacgagguccgccagaucgcgcccggccagaccggggugaucgccgacuacaacuacaagcuccccgacgacuucaccggcugcgugaucgccuggaacagcgucaagcaggacgcccugaccggcgggaacuaccuguaccgccucuuccggaaguccaagcugaagcccuucgagcgggacaucagcacggagaucuaccaggccggcuccaccccgugcaacggccagguggggcugaacugcuacuacccccucgagcgcuacggguuccaccccaccaccggcgugaacuaccagcccuuccgggucguggugcugagcuucgagcugcucaacggcccggcgaccgucugcgggcccaagcuguccacgacccuggugaaggacaagugcgugaacuucaacuucaacggccugaccgggaccggcguccucacgaccagcaagaagcaguuccugcccuuccagcaguucgggcgcgacaucuccgacaccaccgacgccgugcgcgacccccagacgcuggagauccucgacaucaccccgugcagcuucggcggcguguccgucaucacccccgggaccaacacgagcaaccagguggccgugcuguaccaggacgucaacugcaccgaggugcccauggccauccacgccgagcagcugaccccggcguggcggguguacagcgccggcgccaacgucuuccagacccgcgccgggugccucgugggcgccgagcacgugaacaacuccuacgagugcgacauccccgucggcgcggggaucugcgccagcuaccacuccaugagcucccugcggagcgugaaccagcgcuccaucaucgccuacacgaugagccugggcgccgagaacuccguggcguacagcaacaacuccaucgccauccccaccaacuucaccaucagcgucaccacggagauccuccccguguccaugaccaagaccagcguggacugcaccauguacaucugcggggacuccaucgagugcagcaaccugcugcuccaguacggcuccuucugcacgcagcugaaccgggcccugaccgggaucgccgucgagcaggacaagaacacccaggagguguucgcccaggugaagcagaucuacaagaccccgcccaucaaggacuucggcggcuucaacuucagccagauccuccccgaccccagcaagccguccaagcgcagcuucaucgaggaccugcuguucaacaaggucacgcucgcggacgccggguucaucaagcaguacggcgacugccugggggacaucgccgcccgggaccugaucugcgcccagaaguucaacggccucaccgugcugccgccccugcucaccgacgagaugaucgcgcaguacaccuccgcccugcuggccgggacgaucaccagcggcuggaccuucggcgccggggccgcgcuccagauccccuucgccaugcagauggccuaccgcuucaacggcaucggggugacccagaacguccuguacgagaaccagaagcugaucgccaaccaguucaacuccgcgaucggcaagauccaggacagccucuccagcacggccuccgcccuggggaagcugcaggacguggugaaccagaacgcccaggcccucaacacccuggucaagcagcugagcuccaacuucggcgcgaucagcuccgugcucaacgacauccugagccggcuggacaagguggaggccgagguccagaucgaccgccucaucaccggccggcugcagucccugcagaccuacgugacccagcagcucauccgcgccgccgagauccgggccagcgcgaaccuggccgccacgaagauguccgagugcgugcuggggcagagcaagcgcgucgacuucugcggcaagggguaccaccucauguccuucccccagagcgcgccccacggcguggucuuccugcacgugaccuacgugcccgcccaggagaagaacuucaccaccgcccccgccaucugccacgaggggaaggcccacuucccgcgggagggcgucuucgugagcaacggcacgcacugguucaucacccagcgcaacuucuacgagccccagaucaucaccaccgacaacacguucguguccgggagcugcgacgucgugaucggcaucgugaacaacaccgucuacgacccccugcagcccgagcucgacuccuucaaggaggagcuggacaaguacuucaagaaccacaccagcccggacguggaccugggggacaucuccggcaucaacgccagcguggucaacauccagaaggagaucgaccggcucaacgagguggcgaagaaccugaacgagucccugaucgaccuccaggagcugggcaaguacgagcaguacaucaaguggcccugguacaucuggcugggguucaucgccggccucaucgccaucaucauggugaccaucaugcugugcugcaugacgagcugcugcuccugccugaaggggugcugcagcugcggcuccugcugcaaguucgacgaggacgacagcgagcccguccucaagggggugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12810 - RNA, 4039 nt, Artificial Sequence; identical to SEQ ID NO: 163
  SARS-CoV-2/Wuhan/WIV05/2019__EPI_ISL_402128 spike protein mRNA gc (1-1273)(K986P_V987P) R9515, R10157

SEQ ID NO: 12811 - RNA, 4039 nt, Artificial Sequence
  SARS-CoV-2/Wuhan/WIV05/2019__EPI_ISL_402128 spike protein mRNA gc (1-1273)(K986P_V987P_T887WN_A1020W) R9641
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggugguucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcuggagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12812 - RNA, 4039 nt, Artificial Sequence
  SARS-CoV-2/Wuhan/WIV05/2019__EPI_ISL_402128 spike protein mRNA gc (1-1273)(K986P_V987P_P1069F) R9660
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucuucgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12813 - RNA, 4039 nt, Artificial Sequence
  SARS-CoV-2/Wuhan/WIV05/2019__EPI_ISL_402128 spike protein mRNA gc (1-1273)(K986P_V987P_ H1048Q_H1064N_ H1083N_H1101N) R9661
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccagcugauguccuucccccagagcgccccgcacggcguggucuuccucaacgugacguacguccccgcccaggagaagaacuucaccaccgcccccgcgaucugcaacgacgggaaggcccacuucccccgcgagggcguguucguguccaacgggaccaacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12814 - RNA, 4039 nt, Artificial Sequence
  SARS-CoV-2/Wuhan/WIV05/2019__EPI_ISL_402128 spike protein mRNA gc (1-1273)(I712C_T1077C)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcugcgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccugcgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12815 - RNA, 4039 nt, Artificial Sequence
  SARS-CoV-2/Wuhan/WIV05/2019__EPI_ISL_402128 spike protein mRNA gc (1-1273)(I714C_Y1110C)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccugccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucugcgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12816 - RNA, 4039 nt, Artificial Sequence
  SARS-CoV-2/Wuhan/WIV05/2019__EPI_ISL_402128 spike protein mRNA gc (1-1273)(P715C_P1069C) R9561
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccaucugcaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucugcgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12817 - RNA, 4039 nt, Artificial Sequence
  SARS-CoV-2/Wuhan/WIV05/2019__EPI_ISL_402128 spike protein mRNA gc (1-1273)(G889C_L1034C) R9564
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucugcgccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcgucugcggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12818 - RNA, 4039 nt, Artificial Sequence
  SARS-CoV-2/Wuhan/WIV05/2019__EPI_ISL_402128 spike protein mRNA gc (1-1273)(I909C_Y1047C)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcugcggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaaggggugccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12819 - RNA, 4039 nt, Artificial Sequence
  SARS-CoV-2/Wuhan/WIV05/2019__EPI_ISL_402128 spike protein mRNA gc (1-1273)(Q965C_S1003C)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagugccuguccagcaacuucggcgccaucuccagcgugcugaacgacauccucucccgccuggacaaggucgaggccgaggugcagaucgaccggcugaucaccgggcgccuccagugccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12820 - RNA, 4039 nt, Artificial Sequence
  SARS-CoV-2/Wuhan/WIV05/2019__EPI_ISL_402128 spike protein mRNA gc (1-1273)(F970C_G999C) R9562
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacugcggcgccaucuccagcgugcugaacgacauccucucccgccuggacaaggucgaggccgaggugcagaucgaccggcugaucaccugucgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12821 - RNA, 4039 nt, Artificial Sequence
  SARS-CoV-2/Wuhan/WIV05/2019__EPI_ISL_402128 spike protein mRNA gc (1-1273)(A972C_R995C)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcugcaucuccagcgugcugaacgacauccucucccgccuggacaaggucgaggccgaggugcagaucgacugccugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12822 - RNA, 4039 nt, Artificial Sequence
  SARS-CoV-2/Wuhan/WIV05/2019__EPI_ISL_402128 spike protein mRNA gc (1-1273)(A890C_V1040C) R9560
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucgggugcggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggugcgacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12823 - RNA, 4039 nt, Artificial Sequence
  SARS-CoV-2/Wuhan/WIV05/2019__EPI_ISL_402128 spike protein mRNA gc (1-1273)(T874C_S1055C) R9563
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacugcagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagugcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12824 - RNA, 2263 nt, Artificial Sequence; identical to SEQ ID NO: 166
  SARS-CoV-2/Wuhan/WIV05/2019__EPI_ISL_402128 spike protein mRNA gc (1-681) R9506, R9513

SEQ ID NO: 12825 - RNA, 4333 nt, Artificial Sequence
  SARS-CoV-2/Wuhan/WIV05/2019__EPI_ISL_402128 spike protein mRNA gc (1-1211) LumSynth construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12826 - RNA, 4333 nt, Artificial Sequence
  SARS-CoV-2/Wuhan/WIV05/2019__EPI_ISL_402128 spike protein mRNA gc (1-1211)(K986P_V987P) LumSynth construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12827 - RNA, 4333 nt, Artificial Sequence
  SARS-CoV-2/Wuhan/WIV05/2019__EPI_ISL_402128 spike protein mRNA gc (1-1211)(K986P_V987P_T887WN_A1020W) LumSynth construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggugguucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcuggagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12828 - RNA, 4333 nt, Artificial Sequence
  SARS-CoV-2/Wuhan/WIV05/2019__EPI_ISL_402128 spike protein mRNA gc (1-1211)(K986P_V987P_P1069F) LumSynth construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucuucgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12829 - RNA, 4333 nt, Artificial Sequence
  SARS-CoV-2/Wuhan/WIV05/2019__EPI_ISL_402128 spike protein mRNA gc (1-1211)(K986P_V987P_ H1048Q_H1064N_ H1083N_H1101N) LumSynth construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccagcugauguccuucccccagagcgccccgcacggcguggucuuccucaacgugacguacguccccgcccaggagaagaacuucaccaccgcccccgcgaucugcaacgacgggaaggcccacuucccccgcgagggcguguucguguccaacgggaccaacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12830 - RNA, 4333 nt, Artificial Sequence
  SARS-CoV-2/Wuhan/WIV05/2019__EPI_ISL_402128 spike protein mRNA gc (1-1211)(I712C_T1077C) LumSynth construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcugcgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccugcgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12831 - RNA, 4333 nt, Artificial Sequence
  SARS-CoV-2/Wuhan/WIV05/2019__EPI_ISL_402128 spike protein mRNA gc (1-1211)(I714C_Y1110C) LumSynth construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccugccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucugcgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12832 - RNA, 4333 nt, Artificial Sequence
  SARS-CoV-2/Wuhan/WIV05/2019__EPI_ISL_402128 spike protein mRNA gc (1-1211)(P715C_P1069C) LumSynth construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccaucugcaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucugcgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12833 - RNA, 4333 nt, Artificial Sequence
  SARS-CoV-2/Wuhan/WIV05/2019__EPI_ISL_402128 spike protein mRNA gc (1-1211)(G889C_L1034C) LumSynth construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucugcgccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcgucugcggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12834 - RNA, 4333 nt, Artificial Sequence
  SARS-CoV-2/Wuhan/WIV05/2019__EPI_ISL_402128 spike protein mRNA gc (1-1211)(I909C_Y1047C) LumSynth construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcugcggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaaggggugccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12835 - RNA, 4333 nt, Artificial Sequence
  SARS-CoV-2/Wuhan/WIV05/2019__EPI_ISL_402128 spike protein mRNA gc (1-1211)(Q965C_S1003C) LumSynth construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagugccuguccagcaacuucggcgccaucuccagcgugcugaacgacauccucucccgccuggacaaggucgaggccgaggugcagaucgaccggcugaucaccgggcgccuccagugccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12836 - RNA, 4333 nt, Artificial Sequence
  SARS-CoV-2/Wuhan/WIV05/2019__EPI_ISL_402128 spike protein mRNA gc (1-1211)(F970C_G999C) LumSynth construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacugcggcgccaucuccagcgugcugaacgacauccucucccgccuggacaaggucgaggccgaggugcagaucgaccggcugaucaccugucgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12837 - RNA, 4333 nt, Artificial Sequence
  SARS-CoV-2/Wuhan/WIV05/2019__EPI_ISL_402128 spike protein mRNA gc (1-1211)(A972C_R995C) LumSynth construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcugcaucuccagcgugcugaacgacauccucucccgccuggacaaggucgaggccgaggugcagaucgacugccugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12838 - RNA, 4333 nt, Artificial Sequence
  SARS-CoV-2/Wuhan/WIV05/2019__EPI_ISL_402128 spike protein mRNA gc (1-1211)(A890C_V1040C) LumSynth construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucgggugcggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggugcgacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12839 - RNA, 4333 nt, Artificial Sequence
  SARS-CoV-2/Wuhan/WIV05/2019__EPI_ISL_402128 spike protein mRNA gc (1-1211)(T874C_S1055C) LumSynth construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacugcagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagugcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12840 - RNA, 4357 nt, Artificial Sequence
  SARS-CoV-2/Wuhan/WIV05/2019__EPI_ISL_402128 spike protein mRNA gc (1-1211) Ferritin construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12841 - RNA, 4357 nt, Artificial Sequence
  SARS-CoV-2/Wuhan/WIV05/2019__EPI_ISL_402128 spike protein mRNA gc (1-1211)(K986P_V987P) Ferritin construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12842 - RNA, 4357 nt, Artificial Sequence
  SARS-CoV-2/Wuhan/WIV05/2019__EPI_ISL_402128 spike protein mRNA gc (1-1211)(K986P_V987P_T887WN_A1020W) Ferritin construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggugguucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcuggagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12843 - RNA, 4357 nt, Artificial Sequence
  SARS-CoV-2/Wuhan/WIV05/2019__EPI_ISL_402128 spike protein mRNA gc (1-1211)(K986P_V987P_P1069F) Ferritin construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucuucgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12844 - RNA, 4357 nt, Artificial Sequence
  SARS-CoV-2/Wuhan/WIV05/2019__EPI_ISL_402128 spike protein mRNA gc (1-1211)(K986P_V987P_ H1048Q_H1064N_ H1083N_H1101N) Ferritin construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccagcugauguccuucccccagagcgccccgcacggcguggucuuccucaacgugacguacguccccgcccaggagaagaacuucaccaccgcccccgcgaucugcaacgacgggaaggcccacuucccccgcgagggcguguucguguccaacgggaccaacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12845 - RNA, 4357 nt, Artificial Sequence
  SARS-CoV-2/Wuhan/WIV05/2019__EPI_ISL_402128 spike protein mRNA gc (1-1211)(I712C_T1077C) Ferritin construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcugcgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccugcgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12846 - RNA, 4357 nt, Artificial Sequence
  SARS-CoV-2/Wuhan/WIV05/2019__EPI_ISL_402128 spike protein mRNA gc (1-1211)(I714C_Y1110C) Ferritin construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccugccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucugcgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12847 - RNA, 4357 nt, Artificial Sequence
  SARS-CoV-2/Wuhan/WIV05/2019__EPI_ISL_402128 spike protein mRNA gc (1-1211)(P715C_P1069C) Ferritin construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccaucugcaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucugcgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12848 - RNA, 4357 nt, Artificial Sequence
  SARS-CoV-2/Wuhan/WIV05/2019__EPI_ISL_402128 spike protein mRNA gc (1-1211)(G889C_L1034C) Ferritin construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucugcgccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcgucugcggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12849 - RNA, 4357 nt, Artificial Sequence
  SARS-CoV-2/Wuhan/WIV05/2019__EPI_ISL_402128 spike protein mRNA gc (1-1211)(I909C_Y1047C) Ferritin construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcugcggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaaggggugccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12850 - RNA, 4357 nt, Artificial Sequence
  SARS-CoV-2/Wuhan/WIV05/2019__EPI_ISL_402128 spike protein mRNA gc (1-1211)(Q965C_S1003C) Ferritin construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagugccuguccagcaacuucggcgccaucuccagcgugcugaacgacauccucucccgccuggacaaggucgaggccgaggugcagaucgaccggcugaucaccgggcgccuccagugccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12851 - RNA, 4357 nt, Artificial Sequence
  SARS-CoV-2/Wuhan/WIV05/2019__EPI_ISL_402128 spike protein mRNA gc (1-1211)(F970C_G999C) Ferritin construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacugcggcgccaucuccagcgugcugaacgacauccucucccgccuggacaaggucgaggccgaggugcagaucgaccggcugaucaccugucgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12852 - RNA, 4357 nt, Artificial Sequence
  SARS-CoV-2/Wuhan/WIV05/2019__EPI_ISL_402128 spike protein mRNA gc (1-1211)(A972C_R995C) Ferritin construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcugcaucuccagcgugcugaacgacauccucucccgccuggacaaggucgaggccgaggugcagaucgacugccugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12853 - RNA, 4357 nt, Artificial Sequence
  SARS-CoV-2/Wuhan/WIV05/2019__EPI_ISL_402128 spike protein mRNA gc (1-1211)(A890C_V1040C) Ferritin construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucgggugcggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggugcgacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12854 - RNA, 4357 nt, Artificial Sequence
  SARS-CoV-2/Wuhan/WIV05/2019__EPI_ISL_402128 spike protein mRNA gc (1-1211)(T874C_S1055C) Ferritin construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacugcagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagugcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12855 - RNA, 3943 nt, Artificial Sequence
  SARS-CoV-2/Wuhan/WIV05/2019__EPI_ISL_402128 spike protein mRNA gc (1-1211) Foldon construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12856 - RNA, 3943 nt, Artificial Sequence
  SARS-CoV-2/Wuhan/WIV05/2019__EPI_ISL_402128 spike protein mRNA gc (1-1211)(K986P_V987P) Foldon construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12857 - RNA, 3943 nt, Artificial Sequence
  SARS-CoV-2/Wuhan/WIV05/2019__EPI_ISL_402128 spike protein mRNA gc (1-1211)(K986P_V987P_T887WN_A1020W) Foldon construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggugguucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcuggagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12858 - RNA, 3943 nt, Artificial Sequence
  SARS-CoV-2/Wuhan/WIV05/2019__EPI_ISL_402128 spike protein mRNA gc (1-1211)(K986P_V987P_P1069F) Foldon construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucuucgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12859 - RNA, 3943 nt, Artificial Sequence
  SARS-CoV-2/Wuhan/WIV05/2019__EPI_ISL_402128 spike protein mRNA gc (1-1211)(K986P_V987P_ H1048Q_H1064N_ H1083N_H1101N) Foldon construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccagcugauguccuucccccagagcgccccgcacggcguggucuuccucaacgugacguacguccccgcccaggagaagaacuucaccaccgcccccgcgaucugcaacgacgggaaggcccacuucccccgcgagggcguguucguguccaacgggaccaacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12860 - RNA, 3943 nt, Artificial Sequence
  SARS-CoV-2/Wuhan/WIV05/2019__EPI_ISL_402128 spike protein mRNA gc (1-1211)(I712C_T1077C) Foldon construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcugcgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccugcgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12861 - RNA, 3943 nt, Artificial Sequence
  SARS-CoV-2/Wuhan/WIV05/2019__EPI_ISL_402128 spike protein mRNA gc (1-1211)(I714C_Y1110C) Foldon construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccugccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucugcgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12862 - RNA, 3943 nt, Artificial Sequence
  SARS-CoV-2/Wuhan/WIV05/2019__EPI_ISL_402128 spike protein mRNA gc (1-1211)(P715C_P1069C) Foldon construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccaucugcaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucugcgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12863 - RNA, 3943 nt, Artificial Sequence
  SARS-CoV-2/Wuhan/WIV05/2019__EPI_ISL_402128 spike protein mRNA gc (1-1211)(G889C_L1034C) Foldon construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucugcgccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcgucugcggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12864 - RNA, 3943 nt, Artificial Sequence
  SARS-CoV-2/Wuhan/WIV05/2019__EPI_ISL_402128 spike protein mRNA gc (1-1211)(I909C_Y1047C) Foldon construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcugcggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaaggggugccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12865 - RNA, 3943 nt, Artificial Sequence
  SARS-CoV-2/Wuhan/WIV05/2019__EPI_ISL_402128 spike protein mRNA gc (1-1211)(Q965C_S1003C) Foldon construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagugccuguccagcaacuucggcgccaucuccagcgugcugaacgacauccucucccgccuggacaaggucgaggccgaggugcagaucgaccggcugaucaccgggcgccuccagugccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12866 - RNA, 3943 nt, Artificial Sequence
  SARS-CoV-2/Wuhan/WIV05/2019__EPI_ISL_402128 spike protein mRNA gc (1-1211)(F970C_G999C) Foldon construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacugcggcgccaucuccagcgugcugaacgacauccucucccgccuggacaaggucgaggccgaggugcagaucgaccggcugaucaccugucgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12867 - RNA, 3943 nt, Artificial Sequence
  SARS-CoV-2/Wuhan/WIV05/2019__EPI_ISL_402128 spike protein mRNA gc (1-1211)(A972C_R995C) Foldon construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcugcaucuccagcgugcugaacgacauccucucccgccuggacaaggucgaggccgaggugcagaucgacugccugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12868 - RNA, 3943 nt, Artificial Sequence
  SARS-CoV-2/Wuhan/WIV05/2019__EPI_ISL_402128 spike protein mRNA gc (1-1211)(A890C_V1040C) Foldon construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucgggugcggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggugcgacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12869 - RNA, 3943 nt, Artificial Sequence
  SARS-CoV-2/Wuhan/WIV05/2019__EPI_ISL_402128 spike protein mRNA gc (1-1211)(T874C_S1055C) Foldon construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacugcagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagugcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggagcggcuacauccccgaggccccgcgcgacgggcaggccuacgugcggaaggacggcgaguggguccugcucagcaccuuccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12870 - RNA, 4315 nt, Artificial Sequence
  SARS-CoV-2/Wuhan/WIV05/2019__EPI_ISL_402128 spike protein mRNA gc (1-1211) WhcAg construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12871 - RNA, 4315 nt, Artificial Sequence
  SARS-CoV-2/Wuhan/WIV05/2019__EPI_ISL_402128 spike protein mRNA gc (1-1211)(K986P_V987P) WhcAg construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12872 - RNA, 4315 nt, Artificial Sequence
  SARS-CoV-2/Wuhan/WIV05/2019__EPI_ISL_402128 spike protein mRNA gc (1-1211)(K986P_V987P_T887WN_A1020W) WhcAg construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggugguucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcuggagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12873 - RNA, 4315 nt, Artificial Sequence
  SARS-CoV-2/Wuhan/WIV05/2019__EPI_ISL_402128 spike protein mRNA gc (1-1211)(K986P_V987P_P1069F) WhcAg construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucuucgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12874 - RNA, 4315 nt, Artificial Sequence
  SARS-CoV-2/Wuhan/WIV05/2019__EPI_ISL_402128 spike protein mRNA gc (1-1211)(K986P_V987P_ H1048Q_H1064N_ H1083N_H1101N) WhcAg construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccagcugauguccuucccccagagcgccccgcacggcguggucuuccucaacgugacguacguccccgcccaggagaagaacuucaccaccgcccccgcgaucugcaacgacgggaaggcccacuucccccgcgagggcguguucguguccaacgggaccaacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12875 - RNA, 4315 nt, Artificial Sequence
  SARS-CoV-2/Wuhan/WIV05/2019__EPI_ISL_402128 spike protein mRNA gc (1-1211)(I712C_T1077C) WhcAg construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcugcgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccugcgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12876 - RNA, 4315 nt, Artificial Sequence
  SARS-CoV-2/Wuhan/WIV05/2019__EPI_ISL_402128 spike protein mRNA gc (1-1211)(I714C_Y1110C) WhcAg construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccugccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucugcgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12877 - RNA, 4315 nt, Artificial Sequence
  SARS-CoV-2/Wuhan/WIV05/2019__EPI_ISL_402128 spike protein mRNA gc (1-1211)(P715C_P1069C) WhcAg construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccaucugcaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucugcgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12878 - RNA, 4315 nt, Artificial Sequence
  SARS-CoV-2/Wuhan/WIV05/2019__EPI_ISL_402128 spike protein mRNA gc (1-1211)(G889C_L1034C) WhcAg construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucugcgccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcgucugcggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12879 - RNA, 4315 nt, Artificial Sequence
  SARS-CoV-2/Wuhan/WIV05/2019__EPI_ISL_402128 spike protein mRNA gc (1-1211)(I909C_Y1047C) WhcAg construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcugcggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaaggggugccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12880 - RNA, 4315 nt, Artificial Sequence
  SARS-CoV-2/Wuhan/WIV05/2019__EPI_ISL_402128 spike protein mRNA gc (1-1211)(Q965C_S1003C) WhcAg construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagugccuguccagcaacuucggcgccaucuccagcgugcugaacgacauccucucccgccuggacaaggucgaggccgaggugcagaucgaccggcugaucaccgggcgccuccagugccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12881 - RNA, 4315 nt, Artificial Sequence
  SARS-CoV-2/Wuhan/WIV05/2019__EPI_ISL_402128 spike protein mRNA gc (1-1211)(F970C_G999C) WhcAg construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacugcggcgccaucuccagcgugcugaacgacauccucucccgccuggacaaggucgaggccgaggugcagaucgaccggcugaucaccugucgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12882 - RNA, 4315 nt, Artificial Sequence
  SARS-CoV-2/Wuhan/WIV05/2019__EPI_ISL_402128 spike protein mRNA gc (1-1211)(A972C_R995C) WhcAg construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcugcaucuccagcgugcugaacgacauccucucccgccuggacaaggucgaggccgaggugcagaucgacugccugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12883 - RNA, 4315 nt, Artificial Sequence
  SARS-CoV-2/Wuhan/WIV05/2019__EPI_ISL_402128 spike protein mRNA gc (1-1211)(A890C_V1040C) WhcAg construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucgggugcggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggugcgacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12884 - RNA, 4315 nt, Artificial Sequence
  SARS-CoV-2/Wuhan/WIV05/2019__EPI_ISL_402128 spike protein mRNA gc (1-1211)(T874C_S1055C) WhcAg construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacugcagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagugcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaagggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12885 - RNA, 4141 nt, Artificial Sequence
  SARS-CoV-2/Wuhan/WIV05/2019__EPI_ISL_402128 spike protein mRNA gc (1-1147) LumSynth construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12886 - RNA, 4141 nt, Artificial Sequence
  SARS-CoV-2/Wuhan/WIV05/2019__EPI_ISL_402128 spike protein mRNA gc (1-1147)(K986P_V987P) LumSynth construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12887 - RNA, 4141 nt, Artificial Sequence
  SARS-CoV-2/Wuhan/WIV05/2019__EPI_ISL_402128 spike protein mRNA gc (1-1147)(K986P_V987P_T887WN_A1020W) LumSynth construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggugguucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcuggagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12888 - RNA, 4141 nt, Artificial Sequence
  SARS-CoV-2/Wuhan/WIV05/2019__EPI_ISL_402128 spike protein mRNA gc (1-1147)(K986P_V987P_P1069F) LumSynth construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucuucgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12889 - RNA, 4141 nt, Artificial Sequence
  SARS-CoV-2/Wuhan/WIV05/2019__EPI_ISL_402128 spike protein mRNA gc (1-1147)(K986P_V987P_ H1048Q_H1064N_ H1083N_H1101N) LumSynth construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccagcugauguccuucccccagagcgccccgcacggcguggucuuccucaacgugacguacguccccgcccaggagaagaacuucaccaccgcccccgcgaucugcaacgacgggaaggcccacuucccccgcgagggcguguucguguccaacgggaccaacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12890 - RNA, 4141 nt, Artificial Sequence
  SARS-CoV-2/Wuhan/WIV05/2019__EPI_ISL_402128 spike protein mRNA gc (1-1147)(I712C_T1077C) LumSynth construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcugcgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccugcgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12891 - RNA, 4141 nt, Artificial Sequence
  SARS-CoV-2/Wuhan/WIV05/2019__EPI_ISL_402128 spike protein mRNA gc (1-1147)(I714C_Y1110C) LumSynth construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccugccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucugcgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12892 - RNA, 4141 nt, Artificial Sequence
  SARS-CoV-2/Wuhan/WIV05/2019__EPI_ISL_402128 spike protein mRNA gc (1-1147)(P715C_P1069C) LumSynth construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccaucugcaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucugcgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12893 - RNA, 4141 nt, Artificial Sequence
  SARS-CoV-2/Wuhan/WIV05/2019__EPI_ISL_402128 spike protein mRNA gc (1-1147)(G889C_L1034C) LumSynth construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucugcgccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcgucugcggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12894 - RNA, 4141 nt, Artificial Sequence
  SARS-CoV-2/Wuhan/WIV05/2019__EPI_ISL_402128 spike protein mRNA gc (1-1147)(I909C_Y1047C) LumSynth construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcugcggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaaggggugccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12895 - RNA, 4141 nt, Artificial Sequence
  SARS-CoV-2/Wuhan/WIV05/2019__EPI_ISL_402128 spike protein mRNA gc (1-1147)(Q965C_S1003C) LumSynth construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagugccuguccagcaacuucggcgccaucuccagcgugcugaacgacauccucucccgccuggacaaggucgaggccgaggugcagaucgaccggcugaucaccgggcgccuccagugccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12896 - RNA, 4141 nt, Artificial Sequence
  SARS-CoV-2/Wuhan/WIV05/2019__EPI_ISL_402128 spike protein mRNA gc (1-1147)(F970C_G999C) LumSynth construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacugcggcgccaucuccagcgugcugaacgacauccucucccgccuggacaaggucgaggccgaggugcagaucgaccggcugaucaccugucgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12897 - RNA, 4141 nt, Artificial Sequence
  SARS-CoV-2/Wuhan/WIV05/2019__EPI_ISL_402128 spike protein mRNA gc (1-1147)(A972C_R995C) LumSynth construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcugcaucuccagcgugcugaacgacauccucucccgccuggacaaggucgaggccgaggugcagaucgacugccugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12898 - RNA, 4141 nt, Artificial Sequence
  SARS-CoV-2/Wuhan/WIV05/2019__EPI_ISL_402128 spike protein mRNA gc (1-1147)(A890C_V1040C) LumSynth construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucgggugcggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggugcgacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12899 - RNA, 4141 nt, Artificial Sequence
  SARS-CoV-2/Wuhan/WIV05/2019__EPI_ISL_402128 spike protein mRNA gc (1-1147)(T874C_S1055C) LumSynth construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacugcagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagugcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcggcgggagcgggggcgggcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12900 - RNA, 4165 nt, Artificial Sequence
  SARS-CoV-2/Wuhan/WIV05/2019__EPI_ISL_402128 spike protein mRNA gc (1-1147) Ferritin construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12901 - RNA, 4165 nt, Artificial Sequence
  SARS-CoV-2/Wuhan/WIV05/2019__EPI_ISL_402128 spike protein mRNA gc (1-1147)(K986P_V987P) Ferritin construct R9664
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12902 - RNA, 4165 nt, Artificial Sequence
  SARS-CoV-2/Wuhan/WIV05/2019__EPI_ISL_402128 spike protein mRNA gc (1-1147)(K986P_V987P_T887WN_A1020W) Ferritin construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggugguucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcuggagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12903 - RNA, 4165 nt, Artificial Sequence
  SARS-CoV-2/Wuhan/WIV05/2019__EPI_ISL_402128 spike protein mRNA gc (1-1147)(K986P_V987P_P1069F) Ferritin construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucuucgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12904 - RNA, 4165 nt, Artificial Sequence
  SARS-CoV-2/Wuhan/WIV05/2019__EPI_ISL_402128 spike protein mRNA gc (1-1147)(K986P_V987P_ H1048Q_H1064N_ H1083N_H1101N) Ferritin construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccagcugauguccuucccccagagcgccccgcacggcguggucuuccucaacgugacguacguccccgcccaggagaagaacuucaccaccgcccccgcgaucugcaacgacgggaaggcccacuucccccgcgagggcguguucguguccaacgggaccaacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12905 - RNA, 4165 nt, Artificial Sequence
  SARS-CoV-2/Wuhan/WIV05/2019__EPI_ISL_402128 spike protein mRNA gc (1-1147)(I712C_T1077C) Ferritin construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcugcgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccugcgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12906 - RNA, 4165 nt, Artificial Sequence
  SARS-CoV-2/Wuhan/WIV05/2019__EPI_ISL_402128 spike protein mRNA gc (1-1147)(I714C_Y1110C) Ferritin construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccugccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucugcgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12907 - RNA, 4165 nt, Artificial Sequence
  SARS-CoV-2/Wuhan/WIV05/2019__EPI_ISL_402128 spike protein mRNA gc (1-1147)(P715C_P1069C) Ferritin construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccaucugcaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucugcgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12908 - RNA, 4165 nt, Artificial Sequence
  SARS-CoV-2/Wuhan/WIV05/2019__EPI_ISL_402128 spike protein mRNA gc (1-1147)(G889C_L1034C) Ferritin construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucugcgccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcgucugcggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12909 - RNA, 4165 nt, Artificial Sequence
  SARS-CoV-2/Wuhan/WIV05/2019__EPI_ISL_402128 spike protein mRNA gc (1-1147)(I909C_Y1047C) Ferritin construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcugcggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaaggggugccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12910 - RNA, 4165 nt, Artificial Sequence
  SARS-CoV-2/Wuhan/WIV05/2019__EPI_ISL_402128 spike protein mRNA gc (1-1147)(Q965C_S1003C) Ferritin construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagugccuguccagcaacuucggcgccaucuccagcgugcugaacgacauccucucccgccuggacaaggucgaggccgaggugcagaucgaccggcugaucaccgggcgccuccagugccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12911 - RNA, 4165 nt, Artificial Sequence
  SARS-CoV-2/Wuhan/WIV05/2019__EPI_ISL_402128 spike protein mRNA gc (1-1147)(F970C_G999C) Ferritin construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacugcggcgccaucuccagcgugcugaacgacauccucucccgccuggacaaggucgaggccgaggugcagaucgaccggcugaucaccugucgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12912 - RNA, 4165 nt, Artificial Sequence
  SARS-CoV-2/Wuhan/WIV05/2019__EPI_ISL_402128 spike protein mRNA gc (1-1147)(A972C_R995C) Ferritin construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcugcaucuccagcgugcugaacgacauccucucccgccuggacaaggucgaggccgaggugcagaucgacugccugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12913 - RNA, 4165 nt, Artificial Sequence
  SARS-CoV-2/Wuhan/WIV05/2019__EPI_ISL_402128 spike protein mRNA gc (1-1147)(A890C_V1040C) Ferritin construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucgggugcggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggugcgacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12914 - RNA, 4165 nt, Artificial Sequence
  SARS-CoV-2/Wuhan/WIV05/2019__EPI_ISL_402128 spike protein mRNA gc (1-1147)(T874C_S1055C) Ferritin construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacugcagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagugcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12915 - RNA, 3751 nt, Artificial Sequence
  SARS-CoV-2/Wuhan/WIV05/2019__EPI_ISL_402128 spike protein mRNA gc (1-1147) Foldon construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12916 - RNA, 3751 nt, Artificial Sequence
  SARS-CoV-2/Wuhan/WIV05/2019__EPI_ISL_402128 spike protein mRNA gc (1-1147)(K986P_V987P) Foldon construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12917 - RNA, 3751 nt, Artificial Sequence
  SARS-CoV-2/Wuhan/WIV05/2019__EPI_ISL_402128 spike protein mRNA gc (1-1147)(K986P_V987P_T887WN_A1020W) Foldon construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggugguucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcuggagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12918 - RNA, 3751 nt, Artificial Sequence
  SARS-CoV-2/Wuhan/WIV05/2019__EPI_ISL_402128 spike protein mRNA gc (1-1147)(K986P_V987P_P1069F) Foldon construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucuucgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12919 - RNA, 3751 nt, Artificial Sequence
  SARS-CoV-2/Wuhan/WIV05/2019__EPI_ISL_402128 spike protein mRNA gc (1-1147)(K986P_V987P_ H1048Q_H1064N_ H1083N_H1101N) Foldon construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccagcugauguccuucccccagagcgccccgcacggcguggucuuccucaacgugacguacguccccgcccaggagaagaacuucaccaccgcccccgcgaucugcaacgacgggaaggcccacuucccccgcgagggcguguucguguccaacgggaccaacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12920 - RNA, 3751 nt, Artificial Sequence
  SARS-CoV-2/Wuhan/WIV05/2019__EPI_ISL_402128 spike protein mRNA gc (1-1147)(I712C_T1077C) Foldon construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcugcgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccugcgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12921 - RNA, 3751 nt, Artificial Sequence
  SARS-CoV-2/Wuhan/WIV05/2019__EPI_ISL_402128 spike protein mRNA gc (1-1147)(I714C_Y1110C) Foldon construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccugccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucugcgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12922 - RNA, 3751 nt, Artificial Sequence
  SARS-CoV-2/Wuhan/WIV05/2019__EPI_ISL_402128 spike protein mRNA gc (1-1147)(P715C_P1069C) Foldon construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccaucugcaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucugcgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12923 - RNA, 3751 nt, Artificial Sequence
  SARS-CoV-2/Wuhan/WIV05/2019__EPI_ISL_402128 spike protein mRNA gc (1-1147)(G889C_L1034C) Foldon construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucugcgccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcgucugcggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12924 - RNA, 3751 nt, Artificial Sequence
  SARS-CoV-2/Wuhan/WIV05/2019__EPI_ISL_402128 spike protein mRNA gc (1-1147)(I909C_Y1047C) Foldon construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcugcggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaaggggugccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12925 - RNA, 3751 nt, Artificial Sequence
  SARS-CoV-2/Wuhan/WIV05/2019__EPI_ISL_402128 spike protein mRNA gc (1-1147)(Q965C_S1003C) Foldon construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagugccuguccagcaacuucggcgccaucuccagcgugcugaacgacauccucucccgccuggacaaggucgaggccgaggugcagaucgaccggcugaucaccgggcgccuccagugccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12926 - RNA, 3751 nt, Artificial Sequence
  SARS-CoV-2/Wuhan/WIV05/2019__EPI_ISL_402128 spike protein mRNA gc (1-1147)(F970C_G999C) Foldon construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacugcggcgccaucuccagcgugcugaacgacauccucucccgccuggacaaggucgaggccgaggugcagaucgaccggcugaucaccugucgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12927 - RNA, 3751 nt, Artificial Sequence
  SARS-CoV-2/Wuhan/WIV05/2019__EPI_ISL_402128 spike protein mRNA gc (1-1147)(A972C_R995C) Foldon construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcugcaucuccagcgugcugaacgacauccucucccgccuggacaaggucgaggccgaggugcagaucgacugccugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12928 - RNA, 3751 nt, Artificial Sequence
  SARS-CoV-2/Wuhan/WIV05/2019__EPI_ISL_402128 spike protein mRNA gc (1-1147)(A890C_V1040C) Foldon construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucgggugcggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggugcgacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12929 - RNA, 3751 nt, Artificial Sequence
  SARS-CoV-2/Wuhan/WIV05/2019__EPI_ISL_402128 spike protein mRNA gc (1-1147)(T874C_S1055C) Foldon construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacugcagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagugcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggagcggcuacauccccgaggccccgcgcgacgggcaggccuacgugcggaaggacggcgaguggguccugcucagcaccuuccugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12930 - RNA, 4123 nt, Artificial Sequence
  SARS-CoV-2/Wuhan/WIV05/2019__EPI_ISL_402128 spike protein mRNA gc (1-1147) WhcAg construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12931 - RNA, 4123 nt, Artificial Sequence
  SARS-CoV-2/Wuhan/WIV05/2019__EPI_ISL_402128 spike protein mRNA gc (1-1147)(K986P_V987P) WhcAg construct R9663
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12932 - RNA, 4123 nt, Artificial Sequence
  SARS-CoV-2/Wuhan/WIV05/2019__EPI_ISL_402128 spike protein mRNA gc (1-1147)(K986P_V987P_T887WN_A1020W) WhcAg construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggugguucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcuggagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12933 - RNA, 4123 nt, Artificial Sequence
  SARS-CoV-2/Wuhan/WIV05/2019__EPI_ISL_402128 spike protein mRNA gc (1-1147)(K986P_V987P_P1069F) WhcAg construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucuucgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12934 - RNA, 4123 nt, Artificial Sequence
  SARS-CoV-2/Wuhan/WIV05/2019__EPI_ISL_402128 spike protein mRNA gc (1-1147)(K986P_V987P_ H1048Q_H1064N_ H1083N_H1101N) WhcAg construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccagcugauguccuucccccagagcgccccgcacggcguggucuuccucaacgugacguacguccccgcccaggagaagaacuucaccaccgcccccgcgaucugcaacgacgggaaggcccacuucccccgcgagggcguguucguguccaacgggaccaacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12935 - RNA, 4123 nt, Artificial Sequence
  SARS-CoV-2/Wuhan/WIV05/2019__EPI_ISL_402128 spike protein mRNA gc (1-1147)(I712C_T1077C) WhcAg construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcugcgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccugcgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12936 - RNA, 4123 nt, Artificial Sequence
  SARS-CoV-2/Wuhan/WIV05/2019__EPI_ISL_402128 spike protein mRNA gc (1-1147)(I714C_Y1110C) WhcAg construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccugccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucugcgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12937 - RNA, 4123 nt, Artificial Sequence
  SARS-CoV-2/Wuhan/WIV05/2019__EPI_ISL_402128 spike protein mRNA gc (1-1147)(P715C_P1069C) WhcAg construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccaucugcaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacgucugcgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12938 - RNA, 4123 nt, Artificial Sequence
  SARS-CoV-2/Wuhan/WIV05/2019__EPI_ISL_402128 spike protein mRNA gc (1-1147)(G889C_L1034C) WhcAg construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucugcgccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcgucugcggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12939 - RNA, 4123 nt, Artificial Sequence
  SARS-CoV-2/Wuhan/WIV05/2019__EPI_ISL_402128 spike protein mRNA gc (1-1147)(I909C_Y1047C) WhcAg construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcugcggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaaggggugccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12940 - RNA, 4123 nt, Artificial Sequence
  SARS-CoV-2/Wuhan/WIV05/2019__EPI_ISL_402128 spike protein mRNA gc (1-1147)(Q965C_S1003C) WhcAg construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagugccuguccagcaacuucggcgccaucuccagcgugcugaacgacauccucucccgccuggacaaggucgaggccgaggugcagaucgaccggcugaucaccgggcgccuccagugccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12941 - RNA, 4123 nt, Artificial Sequence
  SARS-CoV-2/Wuhan/WIV05/2019__EPI_ISL_402128 spike protein mRNA gc (1-1147)(F970C_G999C) WhcAg construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacugcggcgccaucuccagcgugcugaacgacauccucucccgccuggacaaggucgaggccgaggugcagaucgaccggcugaucaccugucgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12942 - RNA, 4123 nt, Artificial Sequence
  SARS-CoV-2/Wuhan/WIV05/2019__EPI_ISL_402128 spike protein mRNA gc (1-1147)(A972C_R995C) WhcAg construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcugcaucuccagcgugcugaacgacauccucucccgccuggacaaggucgaggccgaggugcagaucgacugccugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12943 - RNA, 4123 nt, Artificial Sequence
  SARS-CoV-2/Wuhan/WIV05/2019__EPI_ISL_402128 spike protein mRNA gc (1-1147)(A890C_V1040C) WhcAg construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucgggugcggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggugcgacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12944 - RNA, 4123 nt, Artificial Sequence
  SARS-CoV-2/Wuhan/WIV05/2019__EPI_ISL_402128 spike protein mRNA gc (1-1147)(T874C_S1055C) WhcAg construct
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacugcagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagugcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccggcgggggcgggagcgacaucgaccccuacaaggaguucggcagcuccuaccagcugcucaacuuccugccccuggacuucuuccccgaccucaacgcccugguggacaccgccaccgcgcuguacgaggaggagcucacggggcgcgagcacugcagcccccaccacaccgccauccggcaggcccuggucugcugggacgagcugaccaagcucaucgccuggauguccagcaacaucaccuccgagcagguccgcacgaucaucgugaaccacgucaacgacaccuggggccugaaggugcggcagagccugugguuccaccucuccugccugaccuucgggcagcacaccgugcaggaguuccuggucagcuucggcguguggauccgcacgcccgccccguaccggccgcccaacgcgccgauccucuccacccugccggagcacaccgugaucugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12945 - RNA, 4039 nt, Artificial Sequence
  SARS-CoV-2/Wuhan/WIV05/2019__EPI_ISL_402128 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacaggaaguuuucgcgcaagugaagcagauuuauaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauacggcgacugucuuggggauaucgcagcccgugacuugauuugcgcucagaaguucaacggacugaccguccugcccccacucuuaacagaugaaaugaucgcccaguauacgucagcacugcuugcuggcaccauuacgagugguuggacauuuggggccggcgcggccuugcagaucccuuucgcuaugcaaauggcauaccgguuuaauggaauaggcgugacccagaacgugcucuaugagaaucagaaacugauugccaaccaguucaacuccgcuaucgggaagauucaagacucucuaagcuccacagccucagcacugggaaaacuccaggacgucguuaaucagaacgcgcaggcccugaauacucuugugaagcaauugagcaguaacuuuggcgcuaucucuuccguacugaaugauauauuaagccgacucgacaagguggaagccgagguccagaucgauagacugauuaccgguaggcuucagucgcugcaaacguacgugacacagcaguugauccgcgcagcugagauucgggccucagcaaaccucgccgcuaccaaaaugucugaaugcguucuggggcagaguaagagaguggacuucuguggaaaaggcuaccaccuaauguccuuuccccaaagcgcgccacauggugucguguuccugcacguuacuuaugugccggcccaggagaagaauuuuaccacagcuccugcaaucugccacgauggcaaagcccauuuccccagggaaggggucuuuguaucuaacggaacucacugguucgugacccagcgcaauuuuuacgagccacagauaauuacaacggacaacaccuucguuagcggcaauugugauguggucaucgggaucgugaacaauacuguauaugacccccuccaaccugagcuggauuccuucaaggaggaacuugacaaauacuuuaagaaccauacaucaccagauguggacuugggagauauuaguggcaucaaugccagcgucguuaacauucagaaggaaauagaccgacugaaugagguggcuaaaaacuuaaacgaaucucucaucgaccugcaggagcuugguaaguaugagcaguacauuaaauggcccugguauaucuggcugggguucauugcaggacuaaucgccauagugauggucaccaucaugcucugcuguaugacuuccugcuguucaugccugaagggcuguugcaguugugguagcugcugcaaauuugaugaagacgauuccgagccuguguugaagggcguuaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12946 - RNA, 4027 nt, Artificial Sequence
  SARS-CoV-2/bat/Yunnan/RaTG13/2013__EPI_ISL_402131 spike protein mRNA human (1-1269)
aggagaaagcuuaccauguucguguuucugguccuccuuccccugguuagcucccagugcgugaacuugaccacaagaacucaauuaccuccagccuacaccaauucuucaacgaggggcguauauuacccggacaagguguuccggaguagcguccugcaccuaacacaggaucucuuucugcccuucuuuuccaacgugacuugguuccaugcuauccacguuucugggaccaauggaauuaaacgcuuugacaacccugugcuuccauucaaugauggugucuauuuugcaucgacagagaagucaaacauaauccgaggcuggauuuucgggaccacucuggacagcaaaacacagaguuugcucaucgugaauaacgccaccaauguaguuauuaaggugugugaauuucaguucugcaacgaucccuuucugggagucuacuaucauaaaaauaacaaguccuggauggagucugaguuccguguguacagcuccgcgaauaacuguacguucgaauaugugucacaaccuuuucugauggaccucgaaggcaagcaggguaauuucaaaaacuuaagagaguuugucuucaagaacaucgauggguacuuuaaaauauacaguaagcacacuccaaucaaucugguuagggaccuucccccuggauucagcgcuuuggagccacugguggaucuaccgauuggcaucaacauuacccgguuucagacacuccuggcccuucaucgcucuuaucugacucccggcgacuccucaagcggguggaccgcaggagccgcugcauacuauguagguuacuugcagccuagaacauuccuccugaaauauaaugaaaacggcaccaucacggaugccguggacugcgcuuuagauccacugagugagacuaaguguacacucaagucuuuuaccgucgaaaaagggauauaccaaacuuccaauuucagggugcagcccacagacagcauuguucgguuuccuaacaucaccaaucuuugcccauucggagagguguuuaacgccacgaccuucgcgucggucuaugcauggaaucgcaagcgaauuucuaacuguguggccgacuacuccguacuguacaauucaacaaguuucagcacuuuuaaaugcuauggcguuucccccaccaaguugaacgaucuauguuucacaaauguguacgcugacucuuuugucaucacuggugaugaggugagacagaucgccccggggcagaccggaaaaauugcagacuauaacuacaagcugccugaugacuucacaggcugcgucauagcuuggaauagcaaacacaucgaugccaaggaaggcgggaacuuuaacuaucucuacaggcuguuccggaaggcgaaucuuaaacccuuugagcgugacauuucaaccgaaaucuaucaagccggaaguaagccauguaacggucagacuggccugaauugcuacuacccuuuguaucgcuacggguucuaucccacggauggagugggccaccagccauacagaguugugguacucuccuuugagcuguuaaacgcacccgcuacagucugcgguccuaaaaagagcaccaaucuggugaaaaacaaguguguuaauuucaacuuuaaugggcuaacuggcaccggagugcucacagaaucuaacaagaaauuccugccauuucaacaguucggcagggacauagccgauaccacugacgcuguccgggacccgcagacacuugagauuuuggauaucacgcccugcucauucgggggagugaguguaaucaccccugguacuaaugccagcaaccagguggcaguucuguaucaagacgucaauuguacagaggugccaguggccauucaugcugaucagcucacccccacauggcgagucuacuccacuggcucuaacguuuuucagacccgcgcggggugccugaucggagcagaacacgugaauaacucguaugagugugacauuccuauaggcgccgguaucugcgcuagcuaccagacgcaaaccaacuccagaucaguggccagucagucuauuaucgcauacacaaugagccuuggggccgaaaauuccguagcuuauucaaacaauagcaucgccauuccaacuaacuucaccauaucugucacaacugagauccugcccguguccaugaccaagacgaguguugauuguacaauguacauuugcggcgacagcaccgaauguucuaauuugcuccugcaguauggauccuuuugcacucaguuaaacagggcacugacaggcaucgcgguggagcaagauaaaaauacccaggaggucuucgcucaggugaagcagauuuacaaaacuccgccuaucaaggacuuugggggauucaacuuuucacaaauacuaccagaucccaguaagccuagcaaacggucguucaucgaagaccuccuguuuaauaagguuacccuugccgaugcagguuucauuaaacaguauggcgacuguuugggggauaucgccgcucgcgaccugauuugcgcccagaaguuuaacggacucacagugcugcccccauuacugacggacgagaugaucgcacaauacaccuccgcucuuuuggccggcacuauaacaucugguuggaccuucggggcgggcgccgcucuccagauuccuuucgcaaugcagauggccuauagauuuaauggaaucggcguaacacagaacguccuguacgaaaaucaaaaacuaauugcuaaccaguucaauagcgccaucgggaagauacaggauucacugaguuccacugcaucugcgcucggaaagcugcaggacguggugaaccaaaacgcccaggcucuuaauaccuuggucaaacagcugagcuccaacuuuggcgccaucucaagcguuuuaaaugauauucucaguaggcuggacaagguggaggcagaaguacagaucgaucgucuuauuacgggucggcugcaaucuuugcagacauacgugacccagcaacucauccgagcugccgagauaagagcauccgccaaccuggcugcgacuaaaaugagcgagugcguccuagggcagucgaagaggguggacuucuguggaaaaggcuaucaucugaugucauuuccccagucugccccacacgguguuguguuccuccacgucaccuacgugccggcacaggaaaagaauuuuacaacugcuccugccauuugccaugauggcaaagcccacuucccccgcgaggggguuuuugugaguaacggaacccauugguucgucacacaacggaauuuuuaugaaccacagaucaucacgaccgacaacacuuucguauccggcagcugugaugugguuauugggaucgugaauaacacagucuacgacccccugcagccugagcuugauucuuuuaaggaggaauuggacaaguauuucaaaaaucacaccagcccagauguggaccugggagacauuuccggcauaaacgcuucaguagugaauauccagaaggagauugauagauuaaacgaagucgccaaaaaucucaacgagagucugaucgaccuucaagaacuggguaaguacgagcaguauauuaaauggcccugguacaucuggcuaggguucauagcaggacucaucgcgauuaucaugguuacuauuaugcugugcuguaugacaagcugcuguucuugcuugaagggcuguugcuccugugguucaugcugcaaguuugaugaggacgauagugaaccugugcugaaaggcgugaaguuacauuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12947 - RNA, 4039 nt, Artificial Sequence
  SARS-CoV-2/Wuhan/HBCDC-HB-01/2019__EPI_ISL_402132 spike protein mRNA human (1-1273)
aggagaaagcuuaccauguucguguuucugguccuccuuccccugguuagcucccagugcgugaacuugaccacaagaacucaauuaccuccagccuacacuaauucuaucaccaggggcguauauuacccggacaagguguuccggucaaguguccugcacagcacacaggaucuauuucuccccuucuuuuccaacgugacuugguuccaugcuauucacguuucugggaccaauggaacaaaacgcuuugacaacccugugcugccauucaaugauggugucuauuuugcaucgaccgagaagucaaacauaauccgaggcuggauuuucgggacuacacuugacagcaaaacccagagucuguugaucgugaauaacgccacgaauguaguuauuaaggugugugaauuucaguucugcaacgaucccuuucucggagucuacuaucauaaaaauaacaaguccuggauggagucugaguuccguguguacagcuccgcgaauaacuguacuuucgaguaugugucacaaccuuuucugauggaccuggaaggcaagcaggguaauuucaaaaaccucagagaguuugucuucaagaacaucgauggguacuuuaaaauauacaguaagcacaccccaaucaauuuaguuagggaccugccccagggauucagcgcucuugagccuuugguggaucugccaauuggcaucaacauuacacgguuucagacucuacucgcccugcaucgcucuuaucuuaccccgggcgacuccucaagcggguggacagcaggagccgcugcauacuauguagguuaccugcaacccagaaccuucuugcucaaauauaaugaaaacggcacgaucacugaugccguggacugcgcucuggauccuuuaagugagacaaaguguacccugaagucuuuuacugucgaaaaagggauauaccagacauccaauuucagggugcagccaaccgagagcauuguucgguuucccaacaucacgaaucucugcccuuucggagagguguuuaacgccacccgcuucgcgucggucuaugcauggaaucgaaagagaauuucuaacuguguggccgacuacuccguacuuuacaauucagcuaguuucagcacauuuaaaugcuauggcguuuccccaacuaagcugaacgacuuguguuucaccaauguguacgccgauucuuuugucaucaggggugacgaagugcggcagaucgcacccgggcaaacaggaaaaauugcugauuauaacuacaagcuaccggacgauuucacuggcugcgucauagccuggaauagcaacaaccuggacucaaaagugggcgggaauuauaacuaccucuaucgucuguuucgcaagaguaaucuuaagccuuucgagagagauaucuccaccgaaauuuaccaggcgggaagcacacccuguaacgguguugagggcuuuaauugcuacuucccacugcagucuuauggguuucaaccuaccaacggagugggcuaccagcccuauaggguagucguguugucauucgaacuccugcacgccccagcaacuguuugcggucccaaaaagaguacgaauuuagugaaaaacaagugugucaauuuuaacuucaaugggcugacaggcaccggagugcuaacugagagcaacaaaaaguuucucccuuuccagcaguucggccgggacaucgcugauaccacagacgccguacgagauccacaaacccuggagauacuugacauuacuccgugcuccuuugggggagugucuguuaucacacccgguacgaauaccucgaaccaggucgcuguguuguaccaggacgugaauuguacugaagucccuguugccauccacgcagaucagcugacaccaaccuggcgcguguauagcacaggcuccaacguguuccaaacuagagccgggugccucauuggagcugagcauguaaacaauucauacgaaugugacauccccauuggcgcggguauaugcgcaaguuaucagacccagacgaacucuccuaggcgggcccgcagcgucgcuucccagucaaucauugccuacaccaugagccugggggcagaaaauucuguggccuacuccaacaauaguaucgcuaucccaacaaacuuuacuauuagcguuaccacagaaauacuucccgugucuaugacuaagaccuccgucgauuguacgauguauaucugcggcgacucaacagaguguaguaaucuguugcuccaauacggcagcuucugcacccagcugaacagagccuuaacuggaauugcaguggagcaggauaaaaauacacaggaaguuuuugcgcaagugaagcagaucuauaaaaccccgccuauuaaggacuucgggggauuuaacuucucgcagauccugccagaucccuccaaaccuucuaagaggagcuuuauagaggaccuacucuucaauaagguaacucuggcugaugccgguuuuaucaaacaauacggcgacugucuuggggauauugcagcccgugacuugaucugcgcucagaaguucaacggacugaccguccugcccccacucuuaacagaugaaaugauugcccaguauacgucagcacugcuugcuggcaccaucacgagugguuggacauucggggccggcgcggccuugcagauaccuuuugcuaugcaaauggcauaccgguucaauggaauuggcgugacccagaacgugcucuaugagaaucagaaacugaucgccaaccaguuuaacuccgcuauugggaagauccaagacucucuaagcuccacagccucagcacugggaaaacuccaggacgucguuaaucagaacgcgcaggcccugaauacucuugugaagcaauugagcaguaacuucggcgcuauaucuuccguacugaaugauaucuuaagccgacucgacaagguggaagccgagguccagauugauagacugaucaccgguaggcuucagucgcugcaaacguacgugacacagcaguugauucgcgcagcugagauccgggccucagcaaaccucgccgcuaccaaaaugucugaaugcguucuggggcagaguaagagaguggacuuuuguggaaaaggcuaccaccuaauguccuucccccaaagcgcgccacauggugucguguuucugcacguuacuuaugugccggcccaggagaagaauuucaccacagcuccugcaauaugccacgauggcaaagcccauuuucccagggaaggggucuucguaucuaacggaacucacugguuugugacccagcgcaauuucuacgagccacagauuaucacaacggacaacaccuuuguuagcggcaauugugauguggucaucgggauugugaacaauacuguauaugacccccuccaaccugagcuggauuccuucaaggaggaacuugacaaauacuucaagaaccauacaucaccagauguggacuugggagauaucaguggcauuaaugccagcgucguuaacauacagaaggaaaucgaccgacugaaugagguggcuaaaaacuuaaacgaaucucucauugaccugcaggagcuugguaaguaugagcaguacaucaaauggcccugguauauuuggcugggguuuaucgcaggacuaauagccaucgugauggucaccauuaugcucugcuguaugacuuccugcuguucaugccugaagggcuguugcaguugugguagcugcugcaaauucgaugaagacgauuccgagccuguguugaagggcguuaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12948 - RNA, 4039 nt, Artificial Sequence
  SARS-CoV-2/Guangdong/20SF028/2020__EPI_ISL_403936 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccuguauagcacacaggaucuauuccuccccuuuuucuccaacgugacuugguuucacgcuauccauguuucugggaccaauggaacaaaacgcuucgacaacccugugcugccauuuaaugauggugucuacuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuauuaccacaaaaauaacaaguccuggauggagucugaguuccguguguauagcuccgcgaauaacuguacuuuugaauacgugucacaaccuuuccugauggaccuggaaggcaagcaggguaauuuuaaaaaccucagagaguucgucuuuaagaacauugauggguacuucaaaaucuauaguaagcauaccccaauaaauuuaguuagggaccugccccagggauuuagcgcucuugagccuuugguggaucugccaaucggcauuaacaucacacgguuccagacucuacucgcccugcaccgcucuuaccuuaccccgggcgacuccucaagcggguggacagcaggagccgcugcauauuacguagguuaucugcaacccagaaccuuuuugcucaaauacaaugaaaacggcacgauuacugaugccguggacugcgcucuggauccuuuaagugagacaaaguguacccugaagucuuucacugucgaaaaagggaucuaucagacauccaauuuuagggugcagccaaccgagagcauaguucgguuccccaacauuacgaaucucugcccuuuuggagagguguucaacgccacccgcuucgcgucggucuacgcauggaaucgaaagagaaucucuaacuguguggccgacuacuccguacuuuauaauucagcuaguuuuagcacauucaaaugcuacggcguuuccccaacuaagcugaacgacuuguguuuuaccaauguguaugccgauucuuucgucauuaggggugacgaagugcggcagaucgcacccgggcaaacaggaaaaaucgcugauuacaacuauaagcuaccggacgauuuuacuggcugcgucauugccuggaauagcaacaaccuggacucaaaagugggcgggaauuacaacuaucucuaccgucuguuccgcaagaguaaucuuaagccuuuugagagagauauauccaccgaaaucuaccaggcgggaagcacacccuguaacgguguugagggcuucaauugcuauuuuccacugcagucuuacggguuccaaccuaccaacggagugggcuaucagcccuacaggguagucguguugucauuugaacuccugcaugccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaucaggacgugaauuguacugaagucccuguugccauccacgcagaucagcugacaccaaccuggcgcguguacagcacaggcuccaacguguuucaaacuagagccgggugccucaucggagcugagcacguaaacaauucauaugaaugugacauucccaucggcgcggguauuugcgcaaguuaccagacccagacgaacucuccuaggcgggcccgcagcgucgcuucccagucaauaaucgccuacaccaugagccugggggcagaaaauucuguggccuauuccaacaauaguauugcuaucccaacaaacuucacuaucagcguuaccacagaaauucuucccgugucuaugacuaagaccuccgucgauuguacgauguacauaugcggcgacucaacagaguguaguaaucuguugcuccaauauggcagcuuuugcacccagcugaacagagccuuaacuggaaucgcaguggagcaggauaaaaauacacaggaaguuuucgcgcaagugaagcagauuuacaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauauggcgacugucuuggggauaucgcagcccgugacuugauuugcgcucagaaguucaacggacugaccguccugcccccacucuuaacagaugaaaugaucgcccaguacacgucagcacugcuugcuggcaccauuacgagugguuggacauuuggggccggcgcggccuugcagaucccuuucgcuaugcaaauggcauaucgguuuaauggaauaggcgugacccagaacgugcucuacgagaaucagaaacugauugccaaccaguucaacuccgcuaucgggaagauucaagacucucuaagcuccacagccucagcacugggaaaacuccaggacgucguuaaucagaacgcgcaggcccugaauacucuugugaagcaauugagcaguaacuuuggcgcuaucucuuccguacugaaugauauauuaagccgacucgacaagguggaagccgagguccagaucgauagacugauuaccgguaggcuucagucgcugcaaacguacgugacacagcaguugauccgcgcagcugagauucgggccucagcaaaccucgccgcuaccaaaaugucugaaugcguucuggggcagaguaagagaguggacuucuguggaaaaggcuaucaucuaauguccuuuccccaaagcgcgccacacggugucguguuccugcauguuacuuacgugccggcccaggagaagaauuuuaccacagcuccugcaaucugccacgauggcaaagcccacuuccccagggaaggggucuuuguaucuaacggaacucauugguucgugacccagcgcaauuuuuaugagccacagauaauuacaacggacaacaccuucguuagcggcaauugugauguggucaucgggaucgugaacaauacuguauacgacccccuccaaccugagcuggauuccuucaaggaggaacuugacaaauauuuuaagaaccacacaucaccagauguggacuugggagauauuaguggcaucaaugccagcgucguuaacauucagaaggaaauagaccgacugaaugagguggcuaaaaacuuaaacgaaucucucaucgaccugcaggagcuugguaaguacgagcaguauauuaaauggcccugguacaucuggcugggguucauugcaggacuaaucgccauagugauggucaccaucaugcucugcuguaugacuuccugcuguucaugccugaagggcuguugcaguugugguagcugcugcaaauuugaugaagacgauuccgagccuguguugaagggcguuaagcugcauuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12949 - RNA, 4039 nt, Artificial Sequence
  SARS-CoV-2/Shenzhen/SZTH-001/2020__EPI_ISL_406592 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacaggaaguuuucgcgcaagugaagcagauuuauaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauacggcgacugucuuggggauaucgcagcccgugacuugauuugcgcucagaaguucaacggacugaccguccugcccccacucuuaacagaugaaaugaucgcccaguauacgucagcacugcuugcuggcaccauuacgagugguuggacauuuggggccggcgcggccuugcagaucccuuucgcuaugcaaauggcauaccgguuuaauggaauaggcgugacccagaacgugcucuaugagaaucagaaacugauugccaaccaguucaacuccgcuaucgggaagauucaagacucucuaagcuccacagccucagcacugggaaaacuccaggacgucguuaaucagaacgcgcaggcccugaauacucuugugaagcaauugagcaguaacuuuggcgcuaucucuuccguacugaaugauauauuaagccgacucgacaagguggaagccgagguccagaucgauagacugauuaccgguaggcuucagucgcugcaaacguacgugacacagcaguugauccgcgcagcugagauucgggccucagcaaaccucgccgcuaccaaaaugucugaaugcguucuggggcagaguaagagaguggacuucuguggaaaaggcuaccaccuaauguccuuuccccaaagcgcgccacauggugucguguuccugcacguuacuuaugugccggcccaggagaagaauuuuaccacagcuccugcaaucugccacgauggcaaagcccauuuccccagggaaggggucuuuguaucuaacggaacucacugguucgugacccagcgcaauuuuuacgagccacagauaauuacaacggacaacaccuucguuagcggcaauugugaugugcucaucgggaucgucaacaauacuguguaugacccccugcaaccugagcuugauuccuucaaggaagaguuggacaaauacuuuaagaaccauacaucaccagauguagaccugggagauauuaguggcaucaaugccagcguggucaacauucagaaggaaauagaccgauuaaaugagguugcuaaaaaccucaacgaaucucugaucgaccuucaggagcuggguaaguaugagcaguacauuaaauggcccugguauaucuggcuaggguucauugcaggacucaucgccauagugauggugaccaucaugcugugcuguaugacuuccugcuguucaugcuugaagggcuguugcaguugugguagcugcugcaaauuugaugaagacgauuccggcccuguccugaagggggugaaguuacacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12950 - RNA, 4039 nt, Artificial Sequence
  SARS-CoV-2/Shenzhen/SZTH-004/2020__EPI_ISL_406595 spike protein mRNA human (1-1273)
aggagaaagcuuaccauguucguguuucugguccuccuuccccugguuagcucccagugcgugaacuugaccacaagaacucaauuaccuccagccuacacgaauagcuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcaugggaccgaaagagaaucucuaauuguguggccuacuacuccguacuuuauaacucagcuaguuuuagcacauucaaaugcuacggcguuuccccaacuaagcugaaugacuuguguuuuaccaacguguaugccgauucuuucgucauuaggggugacgaagugcggcagaucgcacccgggcaaacaggaaaaaucgcugauuacaauuauaagcuaccggacgauuuuacuggcugcgucauugccuggaacagcaauaaccuggacucaaaagugggcgggaacuacaauuaucucuaccgucuguuccgcaagaguaaccuuaagccuuuugagagagauauauccaccgaaaucuaccaggcgggaagcacacccuguaaugguguugagggcuucaacugcuauuuuccacugcagucuuacggguuccaaccuaccaauggagugggcuaucagcccuacaggguagucguguugucauuugaacuccugcacgccccagcaacuguuugcggucccaaaaagaguacgaacuuagugaaaaauaagugugucaacuucaauuuuaacgggcugacaggcaccggagugcuaacugagagcaauaaaaaguuccucccuuuccagcaguuuggccgggacauugcugauaccacagacgccguacgagauccacaaacccuggagauccuugacauaacuccgugcuccuucgggggagugucuguuauuacacccgguacgaacaccucgaaucaggucgcuguguuguaucaggacgugaacuguacugaagucccuguugccauccacgcagaucagcugacaccaaccuggcgcguguacagcacaggcuccaauguguuucaaacuagagccgggugccucaucggagcugagcauguaaacaacucauaugaaugugacauucccaucggcgcggguauuugcgcaaguuaccagacccagacuaauucuccuaggcgggcccgcagcgucgcuucccagucaauaaucgccuacaccaugagccugggggcagagaacucuguggccuauuccaauaacaguauugcuaucccaacaaauuucacuaucagcguuaccacagaaauucuucccgugucuaugacuaagaccuccgucgauuguacgauguacauaugcggcgacucaacagaguguaguaaccuguugcuccaauauggaucuuuuugcacccagcugaauagagccuuaacuggcaucgcaguggagcaggauaaaaacacacaggaaguuuucgcgcaagugaagcagauuuacaaaaccccgccuaucaaggacuuugggggauucaauuuuucgcagauucugccagaucccuccaaaccuucuaagaggagcuucaucgaggaccuacucuuuaacaagguaacucuggcugaugccgguuucauaaaacaauauggcgacugucuuggggauaucgcagcccgugacuugauuugcgcucagaaguucaauggacugaccguccugcccccacucuuaacagaugaaaugaucgcccaguacacgucagcacugcuugcuggcaccauuacgagugguuggacauuuggggccggcgcggccuugcagaucccuuucgcuaugcaaauggcauaucgguuuaacggaauaggcgugacccagaaugugcucuacgagaaccagaaacugauugccaaucaguucaacuccgcuaucgggaagauucaagacucucuaagcuccacagccucagcacugggaaaacuccaggacgucguuaaccagaaugcgcaggcccugaacacucuugugaagcaauugagcaguaauuuuggcgcuaucucuuccguacugaacgauauauuaagccgacucgacaagguggaagccgagguccagaucgauagacugauuaccgguaggcuucagucgcugcaaacguacgugacacagcaguugauccgcgcagcugagauucgggccucagcaaaucucgccgcuaccaaaaugucugaaugcguucuggggcagaguaagagaguggacuucuguggaaaaggcuaucaccuaauguccuuuccccaaagcgcgccacauggugucguguuccugcacguuacuuacgugccggcccaggagaagaacuuuaccacagcuccugcaaucugccacgauggcaaagcccauuuccccagggaaggggucuuuguaucuaauggaacucacugguucgugacccagcgcaacuuuuaugagccacagauaauuacaacggacaauaccuucguuagcggcaacugugauguggucaucgggaucgugaauaacacuguauacgacccccuccaaccugagcuggauuccuucaaggaagaacuugacaaauauuuuaagaaucauacaucaccagauguggacuugggagauauuaguggcaucaacgccagcgucguuaauauucagaaggaaauagaccgacugaacgagguggcuaaaaauuuaaacgaaucucucaucgaccugcaggagcuugguaaguacgagcaguauauuaaauggcccugguacaucuggcugggguucauugcaggacuaaucgccauagugauggucaccaucaugcucugcuguaugacuuccugcuguucaugccugaagggcuguugcaguugugguagcugcugcaaauuugaugaagacgauuccgagccuguguugaagggcguuaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12951 - RNA, 4039 nt, Artificial Sequence
  SARS-CoV-2/France/IDF0372/2020__EPI_ISL_406596 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccuuucuuuacaauucagcuaguuucagcacauuuaaaugcuauggcguauccccaacuaagcugaacgacuuguguuucaccaauguuuacgccgauucuuuugugauuaggggugacgaaguccggcagaucgcacccgggcaaacaggaaaaaucgcugauuauaacuacaagcuaccggacgauuucacuggcugcgugauugccuggaauagcaacaaccuggacucaaaagucggcgggaauuauaacuaccucuaucgucuguuucgcaagaguaaucuuaagccuuucgagagagauauauccaccgaaaucuaccaggcgggaagcacacccuguaacgguguggagggcuuuaauugcuacuucccacugcagucuuauggguuucaaccuaccaacggaguuggcuaccagcccuauagggugguagucuugucauucgaacuccugcacgccccagcaacugugugcggucccaaaaagaguacgaauuuaguuaaaaacaagugugugaauuuuaacuucaaugggcugacaggcaccggaguccuaacugagagcaacaaaaaguuccucccuuuucagcaguucggccgggacauugcugauaccacagacgccgugcgagauccacaaacccuggagauccuugacauaacuccgugcuccuuugggggaguaucugugauuacacccgguacgaauaccucgaaccagguugcugucuuguaccaggacgugaauuguacugaagugccugucgccauccacgcagaucagcugacaccaaccuggcgcguuuauagcacaggcuccaacguguuccaaacuagagccgggugccucaucggagcugagcaugugaacaauucauacgaaugugacauucccaucggcgcggguauuugcgcaaguuaucagacccagacgaacucuccuaggcgggcccgcagcguagcuucccagucaauaaucgccuacaccaugagccugggggcagaaaauucugucgccuacuccaacaauaguauugcuaucccaacaaacuuuacuaucagcgugaccacagaaauucuucccguuucuaugacuaagaccuccguggauuguacgauguauauaugcggcgacucaacagaguguaguaaucuguugcuccaauacggcagcuucugcacccagcugaacagagccuuaacuggaaucgcagucgagcaggauaaaaauacacaggaaguguuugcgcaaguuaagcagauuuauaaaaccccgccuaucaaggacuucgggggauuuaacuucucgcagauucugccagaucccuccaaaccuucuaagaggagcuuuaucgaggaccuacucuucaauaaggugacucuggcugaugccgguuucauaaaacaauacggcgacugucuuggggauaucgcagcccgugacuugauuugcgcucagaaguuuaacggacugaccguacugcccccacucuuaacagaugaaaugaucgcccaguauacgucagcacugcuugcuggcaccauuacgagugguuggacauucggggccggcgcggccuugcagaucccuuuugcuaugcaaauggcauaccgguucaauggaauaggcgucacccagaacgugcucuaugagaaucagaaacugauugccaaccaguuuaacuccgcuaucgggaagauucaagacucucuaagcuccacagccucagcacugggaaaacuccaggacguggucaaucagaacgcgcaggcccugaauacucuuguuaagcaauugagcaguaacuucggcgcuaucucuuccgugcugaaugauauauuaagccgacucgacaagguagaagccgaggugcagaucgauagacugauuaccgguaggcuucagucgcugcaaacguacgucacacagcaguugauccgcgcagcugagauucgggccucagcaaaccucgccgcuaccaaaaugucugaaugcgugcuggggcagaguaagagaguugacuuuuguggaaaaggcuaccaccuaauguccuucccccaaagcgcgccacaugguguggucuuucugcacgugacuuauguuccggcccaggagaagaauuucaccacagcuccugcaaucugccacgauggcaaagcccauuuucccagggaagggguguucgucucuaacggaacucacugguuuguaacccagcgcaauuucuacgagccacagauaauuacaacggacaacaccuucgugagcggcaauugugauguugugaucgggaucgucaacaauacuguguaugacccccuccaaccugagcuggauuccuuuaaggaggaacuugacaaauacuucaagaaccauacaucaccagauguagacuugggagauauuaguggcaucaaugccagcguggucaacauucagaaggaaauagaccgacugaaugagguugcuaaaaacuuaaacgaaucucucaucgaccugcaggagcuugguaaguaugagcaguacauuaaauggcccugguauaucuggcugggguuuauugcaggacuaaucgccauagugauggugaccaucaugcucugcuguaugacuuccugcuguucaugccugaagggcuguugcaguugugguagcugcugcaaauucgaugaagacgauuccgagccugucuugaagggcgugaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12952 - RNA, 4039 nt, Artificial Sequence
  SARS-CoV-2/Australia/VIC01/2020__EPI_ISL_406844 spike protein mRNA human (1-1273)
aggagaaagcuuaccauguucguguuucugguccuccuuccccugguuagcucccagugcgugaacuugaccacaagaacucaauuaccuccagccuacaccaauucuuucacgaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcagauaucuuaccccgggcgacucuuccucaggguggacagcaggagccgcugcauacuauguagguuaccugcaacccaggaccuuuuugcucaaauauaaugaaaacggcacgauuacugaugccguggacugcgcucuggauccuuuaagcgagacaaaguguacccugaagaguuucacugucgaaaaagggaucuaccagacaucuaauuuucgggugcagccaaccgaguccauaguucgcuuccccaacauuacgaaucucugcccuuuuggagagguguucaacgccacccgauucgcgagcgucuaugcauggaauagaaagaggaucucgaacuguguggccgacuacucuguacuuuacaauuccgcuucauuuaguacauucaaaugcuauggcguuagcccaacuaagcugaacgacuuguguuuuaccaauguguacgccgauuccuucgucauucggggugacgaagugcgucagaucgcacccgggcaaacaggaaaaaucgcugauuauaacuacaagcuaccggacgauuuuacuggcugcgucauugccuggaacucuaauaaccuggacagcaaagugggcgggaauuauaacuaccucuaucgccuguucagaaagucaaaucuuaagccuuuugagagggauauaaguaccgaaaucuaccaggcgggauccacacccuguaacgguguugagggcuucaauugcuacuuuccacugcagagcuauggguuccaaccuaccaacggagugggcuaccagcccuaucggguagucguguugucuuuugaacuccugcacgccccagcaacuguuugcggucccaaaaagucaacgaauuuagugaaaaacaagugugucaauuucaacuuuaaugggcugacaggcaccggagugcuaacugagaguaacaaaaaguuccucccuuuccagcaguuuggccgagacauugcugauaccacagacgccguacgcgauccacaaacccuggagauccuugacauaacuccgugcagcuucgggggaguguccguuauuacacccgguacgaauaccucuaaccaggucgcuguguuguaccaggacgugaauuguacugaagucccuguugccauccacgcagaucagcugacaccaaccuggagaguguauucgacaggcagcaacguguuucaaacuagggccgggugccucaucggagcugagcauguaaacaauuccuacgaaugugacauucccaucggcgcggguauuugcgcaucauaucagacccagacgaacaguccucggcgcgccagaucugucgcuagccaguccauaaucgccuacaccaugucacugggggcagagaauagcguggccuacucuaacaauuccauugcuaucccaacaaacuucacuaucaguguuaccacagaaauucuucccgugagcaugacuaagaccucugucgauuguacgauguauauaugcggcgacuccacagaguguucaaaucuguugcuccaauacggaaguuuuugcacccagcugaacagggccuuaacuggcaucgcaguggagcaggauaaaaauacacaggaaguuuucgcgcaagugaagcagauuuauaaaaccccgccuaucaaggacuuugggggauucaacuuuagccagauucugccagaucccucgaaaccuuccaagcguucuuucaucgaggaccuacucuuuaauaagguaacucuggcugaugccgguuucauaaaacaauacggcgacugucuuggggauaucgcagcccgggacuugauuugcgcucagaaguucaacggacugaccguccucccuccacuguuaacagaugaaaugaucgcccaguauacgagcgcacugcuugcuggcaccauuacuucagguuggacauuuggggccggcgcggccuugcagaucccuuucgcuaugcaaauggcauaccgauuuaauggaauaggcgugacccagaacgugcucuaugagaaucagaaacugauugccaaccaguucaacagugcuaucgggaagauucaagacucccuaucuagcacagccuccgcacugggaaaacuccaggacgucguuaaucagaacgcgcaggcccugaauacucuugugaagcaauugucaagcaacuuuggcgcuaucaguucuguacugaaugauauauuauccagacucgacaagguggaagccgagguccagaucgauaggcugauuaccggucgccuucagagccugcaaacguacgugacacagcaguugauccgggcagcugagauuagagccucggcaaaccucgccgcuaccaaaaugucagaaugcguucuggggcagucuaagaggguggacuucuguggaaaaggcuaccaccuaaugaguuuuccccaauccgcgccacauggugucguguuccugcacguuacuuaugugccggcccaggagaagaauuuuaccacagcacccgcuaucugccacgauggcaaagcccauuucccccgcgaaggggucuuuguaagcaacggaacucacugguucgugacccagcgaaauuuuuacgagccacagauaauuacaacggacaacaccuucguuucuggcaauugugauguggucaucgggaucgugaacaauacuguauaugacccccuccaaccugagcuggauagcuucaaggaagaacuugacaaauacuuuaagaaccauacauccccagauguggacuugggagauauuucaggcaucaaugccagugucguuaacauucagaaggaaauagaccggcugaaugagguggcuaaaaacuuaaacgaaagccucaucgaccugcaggagcuugguaaguaugagcaguacauuaaauggcccugguauaucuggcugggguucauugcaggacuaaucgccauagugauggucaccaucaugcucugcuguaugacuucuugcuguuccugccugaagggcuguugcucaugugguaguugcugcaaauuugaugaagacgauagcgagccuguguugaagggcguuaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12953 - RNA, 4039 nt, Artificial Sequence
  SARS-CoV-2/Germany/BavPat1/2020__EPI_ISL_406862 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgcagcccgugauuugauuugcgcucagaaguucaacggccugaccguccugcccccacucuuaacagacgaaaugaucgcccaguauacgucagcacugcuugcugguaccauuacgaguggguggacauuuggcgccggagcggccuugcagaucccuuucgcuaugcaaauggcauaccgguuuaauggcauaggggugacccagaacgugcucuaugagaaucagaaacugauugccaaccaguucaacuccgcuaucggaaagauucaagauucucuaagcuccacagccucagcacugggcaaacuccaggacgucguuaaucagaacgcgcaggcccugaauacucuugugaagcaauugagcaguaacuuuggugcuaucucuuccguacugaaugacauauuaagccgacucgauaagguggaagccgagguccagaucgacagacugauuaccgggaggcuucagucgcugcaaacguacgugacacagcaguugauccgcgcagcugagauucgggccucagcaaaccucgccgcuaccaaaaugucugaaugcguucugggacagaguaagagaguggauuucuguggcaaagguuaccaccuaauguccuuuccccaaagcgcgccacauggcgucguguuccugcacguuacuuaugugccggcccaggagaagaauuuuaccacagcuccugcaaucugccacgacgggaaagcccauuuccccagggaaggagucuuuguaucuaacggcacucacugguucgugacccagcgcaauuuuuacgagccacagauaauuacaacggauaacaccuucguuagcgggaauugugacguggucaucggaaucgugaacaauacuguauaugauccccuccaaccugagcuggacuccuucaaggaagaacuugauaaauacuuuaagaaccauacaucaccagacguggauuugggcgacauuagugguaucaaugccagcgucguuaacauucagaaggaaauagaucgacugaaugagguggcuaaaaacuuaaacgaaucucucaucgaccugcaggagcuugggaaguaugagcaguacauuaaauggcccugguauaucuggcugggauucauugcaggccuaaucgccauagugauggucaccaucaugcucugcuguaugacuuccugcuguucaugccugaaggguuguugcaguuguggcagcugcugcaaauuugacgaagaugacuccgagccuguguugaaggggguuaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12954 - RNA, 4039 nt, Artificial Sequence
  SARS-CoV-2/Wuhan/HBCDC-HB-02/2020__EPI_ISL_412978 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaauuuucuguugcaauacggcagcuucugcacccagcucaacagagcccugacuggaaucgcaguggagcaggauaaaaauacacaggaaguuuuugcgcaagugaagcagauuuauaaaaccccgccuaucaaggacuucgggggauuuaacuucucgcagauuuuaccagaucccuccaaaccuucuaagaggagcuuuaucgaggaccugcuauucaauaagguaacucucgcugaugccgguuucauaaaacaauacggcgacugucugggggauaucgcagcccgugaccuuauuugcgcucagaaguuuaacggauugaccguccugcccccacuccugacagaugaaaugaucgcccaguauacgucagcauuacuggcuggcaccauuacgagugguuggacauucggggccggcgcggcccuucagaucccuuuugcuaugcaaauggcauaccgguucaauggaauaggcgugacccagaacguguuguaugagaaucagaaacucauugccaaccaguuuaacuccgcuaucgggaagauucaagacucucugagcuccacagccucagcacuaggaaaacugcaggacgucguuaaucagaacgcgcaggcccucaauacucuggugaagcaacuuagcaguaacuucggcgcuaucucuuccguauugaaugauauacugagccgauuagacaagguggaagccgagguccagaucgauagacucauuaccgguaggcugcagucgcuucaaacguacgugacacagcagcugauccgcgcagcugagauucgggccucagcaaacuuggccgcuaccaaaaugucugaaugcguucucgggcagaguaagagaguggacuuuuguggaaaaggcuaccaccugauguccuucccccaaagcgcgccacauggugucguguuucuacacguuacuuaugugccggcccaggagaagaauuucaccacagcuccugcaaucugccacgauggcaaagcccauuuucccagggaaggggucuucguaucuaacggaacucacugguuugugacccagcgcaauuucuacgagccacagauaauuacaacggacaacaccuucguuagcggcaauugugauguggucaucgggaucgugaacaauacuguauaugacccccugcaaccugagcucgauuccuuuaaggaagaacuggacaaauacuucaagaaccauacaucaccagauguggaccuuggagauauuaguggcaucaaugccagcgucguuaacauucagaaggaaauagaccgauugaaugagguggcuaaaaaccugaacgaaucuuuaaucgaccuccaggagcuggguaaguaugagcaguacauuaaauggcccugguauaucuggcuuggguuuauugcaggacugaucgccauagugauggucaccaucaugcuaugcuguaugacuuccugcuguucaugccucaagggcuguugcaguugugguagcugcugcaaauucgaugaagacgauuccgagccugugcugaagggcguuaaguugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12955 - RNA, 4039 nt, Artificial Sequence
  SARS-CoV-2/Australia/QLD02/2020__EPI_ISL_407896 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacaggaaguuuucgcgcaagugaagcagauuuauaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauacggcgacugucuuggggauaucgcagcccgugacuugauuugcgcucagaaguucaacggacugaccguccugcccccacucuuaacagaugaaaugaucgcccaguauacgucagcacugcuugcuggcaccauuacgagugguuggacauuuggggccggcgcggccuugcagaucccuuucgcuaugcaaauggcauaccgguuuaauggaauaggcgugacccagaacgugcucuaugagaaucagaaacugauugccaaccaguucaacuccgcuaucgggaagauucaagacucucuaagcuccacagccucagcacugggaaaacuccaggacgucguuaaucagaacgcgcaggcccugaauacucuugugaagcaauugagcaguaacuuuggcgcuaucucuuccguacugaaugauauauuaagccgacucgacaagguggaagccgagguccagaucgauagacugauuaccgguaggcuucagucgcugcaaacguacgugacacagcaguugauccgcgcagcugagauucgggccucagcaaaccucgccgcuaccaaaaugucugaaugcguucuggggcagaguaagagaguggacuucuguggaaaaggcuaccaccuaauguccuuuccccaaagcgcgccacauggugucguguuccugcacguuacuuaugugccggcccaggagaagaauuuuaccacagcuccugcaaucugccacgauggcaaagcccauuuccccagggaaggggucuuuguaucuaacggaacucacugguucgugacccagcgcaauuuuuacgagccacagauaauuacaacggacaacaccuucguuagcggcaauugugauguggucaucgggaucgugaacaauacuguauaugacccccuccaacuggagcuugauuccuucaaggaagaguuggacaaauacuuuaagaaccauacaucaccugauguggaccugggagauauuaguggcaucaaugccagcgucguuaacauucagaaggaaauagaccgauuaaaugagguggcuaaaaaccucaacgaaucucugaucgaccuucaggagcuggguaaguaugagcaguacauuaaauggccaugguauaucuggcuaggguucauugcaggacucaucgccauagugauggucaccaucaugcugugcuguaugacuuccugcuguucaugcuugaagggcuguugcaguugugguagcugcugcaaauuugaugaagacgauuccgagcccgugcugaagggcguuaaguuacacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12956 - RNA, 4039 nt, Artificial Sequence
  SARS-CoV-2/India/1-31/2020__EPI_ISL_413523 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacaggaaguuuucgcgcaagugaagcagauuuauaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauacggcgacugucuuggggauaucgcagcccgugacuugauuugcgcucagaaguucaacggacugaccguccugcccccacucuuaacagaugaaaugaucgcccaguauacgucagcacugcuugcuggcaccauuacgagugguuggacauuuggggccggcgcggccuugcagaucccuuucgcuaugcaaauggcauaccgguuuaauggaauaggcgugacccagaacgugcucuaugagaaucagaaacugauugccaaccaguucaacuccgucaucgggaagauucaagacucucuaagcuccacagcuucagcccugggaaaacuccaggacguugugaaucagaacgcacaggcgcugaauacucuuguaaagcaauugagcaguaacuuuggcgccaucucuuccgugcugaaugauauauuaagccgacucgacaaggucgaagcugaggugcagaucgauagacugauuaccgguaggcuucagucgcugcaaacguacguuacacagcaguugauccgcgccgcagagauucgggcuucagccaaccucgcagccaccaaaaugucugaaugcgugcuggggcagaguaagagagucgacuucuguggaaaaggcuaccaccuaauguccuuuccccaaagcgcuccacauggugugguuuuccugcacgugacuuaugucccggcgcaggagaagaauuuuaccacagccccugcaaucugccacgauggcaaagcucauuuccccagggaagggguauuugugucuaacggaacucacugguucguuacccagcgcaauuuuuacgagccacagauaauuacaacggacaacaccuucgugagcggcaauugugaugucgugaucgggaucguaaacaauacuguguaugacccccuccaaccugagcuggauuccuucaaggaggaacuugacaaauacuuuaagaaccauacaucaccagaugucgacuugggagauauuaguggcaucaaugccagcguugugaacauucagaaggaaauagaccgacugaaugagguggccaaaaacuuaaacgaaucucucaucgaccugcaggagcuugguaaguaugagcaguacauuaaauggcccugguauaucuggcugggguucauugcuggacuaaucgcaauagucauggugaccaucaugcucugcuguaugacuuccugcuguucaugccugaagggcuguugcaguugugguagcugcugcaaauuugaugaagacgauuccgagccuguuuugaagggcguaaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12957 - RNA, 4039 nt, Artificial Sequence
  SARS-CoV-2/Guangdong/GD2020087-P0008/2020__EPI_ISL_413863 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggaaucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcgggagaucgcacccgggcagacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugaaagagauauauccaccgagaucuaccaagcgggaagcacacccuguaacgguguugaaggcuucaauugcuacuuuccacugcagucuuauggguuccagccuaccaacggagugggcuaccaacccuauaggguagucguguugucauuugagcuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacagacccuggaaauccuugacauaacuccgugcuccuucgggggagugucuguuauuacacccgguacgaauaccucgaaccaagucgcuguguuguaccaggacgugaauuguacugaggucccuguugccauccacgcagaucagcugacaccaaccuggcgcguguauagcacaggcuccaacguguuucagacuagagccgggugccucaucggagcugaacauguaaacaauucauacgagugugacauucccaucggcgcggguauuugcgcaaguuaucaaacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagagauucuucccgugucuaugacuaagaccuccgucgauuguacgauguauauaugcggcgacucaacagaguguaguaaucuguugcuccaguacggcagcuuuugcacccaacugaacagagccuuaacuggaaucgcaguggaacaggauaaaaauacacaggagguuuucgcacaggugaagcaaauuuauaaaaccccgccuaucaaggacuuugggggauucaacuuuucgcagauucugccagaucccuccaaaccuucuaagaggagcuucaucgaagaccuacucuuuaauaagguaacucuggcugaugccgguuucauaaaacaguacggcgacugucuuggggauaucgcagcccgugacuugauuugcgcucaaaaguucaacggacugaccguccugcccccacucuuaacagaugagaugaucgcccaguauacgucagcacugcuugcuggcaccauuacgagugguuggacauuuggggccggcgcggccuugcagaucccuuucgcuaugcagauggcauaccgguuuaauggaauaggcgugacccaaaacgugcucuaugaaaaucagaaacugauugccaaccaguucaacuccgcuaucgggaagauucaggacucucuaagcuccacagccucagcacugggaaaacuccaagacgucguuaaucagaacgcgcaggcccugaauacucuugugaagcaguugagcaguaacuuuggcgcuaucucuuccguacugaaugauauauuaagccgacucgacaagguggaggccgagguccaaaucgauagacugauuaccgguaggcuucagucgcugcagacguacgugacacaacaguugauccgcgcagcugaaauucgggccucagcaaaccucgccgcuaccaaaaugucugagugcguucuggggcagaguaagagaguggacuucuguggaaaaggcuaccaccuaauguccuuuccccagagcgcgccacauggugucguguuccugcacguuacuuaugugccggcccaagaaaagaauuuuaccacagcgccugcuaucugccacgauggcaaagcccauuuccccagggagggggucuuuguaucuaacggaacucacugguucgugacccagcgcaauuuuuacgagccacagauaauuacaacggacaacaccuucguuagcggcaauugugauguggucaucgggaucgugaacaauacuguauaugacccccuccagccugaacuggauuccuucaaggaggaacuugacaaauacuuuaagaaccauacaucaccagauguggacuugggagauauuaguggcaucaaugccagcgucguuaacauucaaaaggagauagaccgacugaaugaaguggcuaaaaacuuaaacgagucucucaucgaccugcaggagcuugguaaguaugaacaguacauuaaauggcccugguauaucuggcugggguucauugcaggacuaaucgccauagugauggucaccaucaugcucugcuguaugacuuccugcuguucaugccugaagggcuguugcaguugugguagcugcugcaaauuugaugaggacgauuccgaaccuguguugaagggcguuaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12958 - RNA, 4039 nt, Artificial Sequence
  SARS-CoV-2/Sweden/01/2020__EPI_ISL_411951 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacaggaaguuuucgcgcaagugaagcagauuuauaaaaccccgccuaucaaggacugugggggauuuaacuucucgcagauucugccagaucccuccaaaccuucuaagaggagcuuuaucgaggaccuacucuucaauaagguaacucuggcugaugccgguuuuauaaaacaauacggcgacugccuuggggauaucgcagcccgugacuugauuugcgcucagaaguucaacggacugaccguccugcccccacucuuaacagaugaaaugaucgcccaguauacgucagcacugcuugcuggcaccauuacgagugguuggacauucggggccggcgcggccuugcagaucccuuuugcuaugcaaauggcauaccgguucaauggaauaggcgugacccagaacgugcucuaugagaaucagaaacugauugccaaccaguuuaacuccgcuaucgggaagauucaagacucucuaagcuccacagccucagcacugggaaaacuccaggacgucguuaaucagaacgcgcaggcccugaauacucuugugaagcaauugagcaguaacuucggcgcuaucucuuccguacugaaugauauauuaagccgacucgacaagguggaagccgagguccagaucgauagacugauuaccgguaggcuucagucgcugcaaacguacgugacacagcaguugauccgcgcagcugagauucgggccucagcaaaccucgccgcuaccaaaaugucugaauguguucuggggcagaguaagagaguggacuuuugcggaaaaggcuaccaccuaauguccuucccccaaagcgcgccacauggugucguguuucugcacguuacuuaugugccggcccaggagaagaauuucaccacagcuccugcaaucugucacgauggcaaagcccauuuucccagggaaggggucuucguaucuaacggaacucacugguuugugacccagcgcaauuucuacgagccacagauaauuacaacggacaacaccuuuguuagcggcaauugcgauguggucaucgggaucgugaacaauacuguauaugacccccuccaaccugagcuggauuccuucaaggaggaacuugacaaauacuucaagaaccauacaucaccagauguggacuugggagauauuaguggcaucaaugccagcgucguuaacauucagaaggaaauagaccgacugaaugagguggcuaaaaacuuaaacgaaucucucaucgaccugcaggagcuugguaaguaugagcaguacauuaaauggcccugguauaucuggcugggguuuauugcaggacuaaucgccauagugauggucaccaucaugcucuguugcaugacuuccuguugcucaugucugaagggcugcuguaguugcgguagcugcuguaaauucgaugaagacgauuccgagccuguguugaagggcguuaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12959 - RNA, 4039 nt, Artificial Sequence
  SARS-CoV-2/Tianmen/HBCDC-HB-07/2020__EPI_ISL_412983 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggaccugaauuguacugaagugccugucgccauccacgcagaucagcucacaccaaccuggcgcguuuauagcacaggcuccaacguguuucaaacuagagccgggugccugaucggagcugagcaugugaacaauucauacgaaugugacauucccaucggcgcggguauuugcgcaaguuaucagacccagacgaacucuccuaggcgggcccgcagcguagcuucccagucaauaaucgccuacaccaugagccuuggggcagaaaauucugucgccuacuccaacaauaguauugcuaucccaacaaacuucacuaucagcgugaccacagaaauucugcccguuucuaugacuaagaccuccguggauuguacgauguauauaugcggcgacucaacagaguguaguaauuugcuccugcaauacggcagcuuuugcacccaguuaaacagagcccugacuggaaucgcagucgagcaggauaaaaauacacaggaaguguucgcgcaaguuaagcagauuuauaaaaccccgccuaucaaggacuuugggggauucaacuuuucgcagauucuaccagaucccuccaaaccuucuaagaggagcuucaucgaggaccuccuguuuaauaaggugacucuugcugaugccgguuucauaaaacaauacggcgacuguuugggggauaucgcagcccgugaccugauuugcgcucagaaguucaacggacucaccguacugcccccauuacugacagaugaaaugaucgcccaguauacgucagcacuuuuggcuggcaccauuacgagugguuggacauuuggggccggcgcggcccuccagaucccuuucgcuaugcaaauggcauaccgguuuaauggaauaggcgucacccagaacgugcuguaugagaaucagaaacuaauugccaaccaguucaacuccgcuaucgggaagauucaagacucucugagcuccacagccucagcacucggaaaacugcaggacguggucaaucagaacgcgcaggcccuuaauacuuugguuaagcaacugagcaguaacuuuggcgcuaucucuuccguguuaaaugauauacucagccgacuggacaagguagaagccgaggugcagaucgauagacuuauuaccgguaggcugcagucguugcaaacguacgucacacagcagcucauccgcgcagcugagauucgggccucagcaaaccuggccgcuaccaaaaugucugaaugcgugcuagggcagaguaagagaguugacuucuguggaaaaggcuaccaccugauguccuuuccccaaagcgcgccacaugguguggucuuccuccacgugacuuauguuccggcccaggagaagaauuuuaccacagcuccugcaaucugccacgauggcaaagcccauuuccccagggaagggguguuugucucuaacggaacucacugguucguaacccagcgcaauuuuuacgagccacagauaauuacaacggacaacaccuucgugagcggcaauugugauguugugaucgggaucgucaacaauacuguguaugacccccugcaaccugagcuugauuccuucaaggaagaguuggacaaauacuuuaagaaccauacaucaccagauguagaccugggagauauuaguggcaucaaugccagcguggucaacauucagaaggaaauagaccgauuaaaugagguugcuaaaaaccucaacgaaucucugaucgaccuucaggagcuggguaaguaugagcaguacauuaaauggcccugguauaucuggcuaggguucauugcaggacucaucgccauagugauggugaccaucaugcugugcuguaugacuuccugcuguucaugcuugaagggcuguugcaguugugguagcugcugcaaauuugaugaagacgauuccgagccuguccugaagggcgugaaguuacacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12960 - RNA, 4039 nt, Artificial Sequence
  SARS-CoV-2/Hong Kong/case42_VM20002493/2020__EPI_ISL_414527 spike protein mRNA human (1-1273)
aggagaaagcuuaccauguucguguuucugguccuccuuccccugguuagcucccagugcgugaacuugaccacaagaacucaauuaccuccagccuacacgaauagcuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucgccaucagcguuacuaccgaaauucuucccgugucuaugacaaagacuuccgucgauuguaccauguauauaugcggcgacucaacggaguguaguaaucuguugcuccaauacggaucuuuuugcacacagcugaacagagcauuaaccggcaucgcgguggagcaggauaaaaauacucaggaaguuuucgcucaagugaagcagauuuauaaaacaccgccuaucaaggacuuugggggauucaacuuuucgcagauucugccagaucccuccaaaccuucuaagaggagcuucaucgaggaccuacucuuuaauaagguaacccuggccgaugcagguuucauaaaacaauacggcgacugucuuggggauaucgccgcucgugacuugauuugcgcccagaaguucaacggacugacuguccugcccccacucuuaaccgaugaaaugaucgcacaguauacaucagcucugcuugccggcacgauuaccagugguuggacuuuuggggcgggcgccgcuuugcagaucccuuucgcaaugcaaauggccuaccgguuuaauggaauaggcgugacacagaacgugcucuaugagaaucagaaacugauugcuaaccaguucaacuccgccaucgggaagauucaagacucucuaagcuccaccgcaucagcgcugggaaaacuccaggacgucguuaaucagaacgcccaggcucugaauacacuugugaagcaauugagcaguaacuuuggcgccaucucuuccguacugaaugauauauuaagccgacucgacaagguggaagcagagguccagaucgauagacugauuacugguaggcuucagucgcugcaaaccuacgugacgcagcaguugauccgcgcugccgagauucgggcaucagccaaccucgcugcgacaaaaaugucugaaugcguucuggggcagaguaagagaguggacuucuguggaaaaggcuaccaccuaauguccuuuccccaaagcgccccacauggugucguguuccugcacguuaccuaugugccggcacaggagaagaauuuuacuaccgcuccugccaucugccacgauggcaaagcccauuuccccagggaaggggucuuuguaucuaacggaacacacugguucgugacucagcgcaauuuuuacgagccacagauaauuaccacagacaacacguucguuagcggcaauugugauguggucaucgggaucgugaacaauaccguauaugacccccuccaaccugagcuggauuccuucaaggaggaacuugacaaauacuuuaagaaccauacuucaccagauguggacuugggagauauuaguggcaucaaugcuagcgucguuaacauucagaaggaaauagaccgacugaaugagguggccaaaaacuuaaacgaaucucucaucgaccugcaggagcuugguaaguaugagcaguacauuaaauggcccugguauaucuggcugggguucauugcaggacuaaucgcgauagugauggucacaaucaugcucugcuguaugaccuccugcuguucaugccugaagggcuguugcaguugugguagcugcugcaaauuugaugaagacgauuccgagccuguguugaagggcguuaagcugcacuacacuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12961 - RNA, 4039 nt, Artificial Sequence
  SARS-CoV-2/USA/CruiseA-23/2020__EPI_ISL_414482 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaagucaagcagggcaauuuuaaaaaccucagagaguucguuuuuaagaacauugaugguuacuucaaaaucuacaguaagcacaccccaauaaauuuagugagggaccugccccagggguuuagcgcucuugagccuuugguagaucugccaaucggaauuaacaucacacgguuccagacucuacucgcccugcaucgcucuuaucuuaccccgggcgacuccucaagcggcuggacagcaggggccgcugcauacuaugugggauaccugcaacccagaaccuuuuugcucaaauauaaugaaaacgguacgauuacugaugccgucgacugcgcucuggauccuuuaagugagacaaaguguacccugaagucuuucacuguggaaaaaggcaucuaccagacauccaauuuuaggguucagccaaccgagagcauagugcgguuccccaacauuacgaaucucugcccuuuuggggaggucuucaacgccacccgcuucgcgucgguguaugcauggaaucgaaagagaaucucuaacuguguagccgacuacuccguucuuuacaauucagcuaguuuuagcacauucaaaugcuauggaguguccccaacuaagcugaacgacuuguguuuuaccaaugucuacgccgauucuuucgugauuaggggcgacgaaguccggcagaucgcacccggucaaacagggaaaaucgcugauuauaacuacaagcuaccggacgauuuuacuggaugcgugauugccuggaauagcaacaaccuggacucaaaaguuggcggcaauuauaacuaccucuaucgucuguuccgcaagaguaaucuuaagccuuuugagagagauauauccaccgaaaucuaccaggcggggagcacacccuguaacggaguggaggguuucaauugcuacuuuccacugcagucuuauggcuuccaaccuaccaacgggguaggauaccagcccuauagggucgugguuuugucauuugaacuccugcacgccccagcaacugugugcggccccaaaaagaguacgaauuuagucaaaaacaagugugugaauuucaacuuuaauggucugacagggaccggcguacuaacugagagcaacaaaaaguuccucccuuuccagcaguuuggacgggacauugcugauaccacagacgccgugcgagauccacaaacccuggagauccuugacauaacuccgugcuccuucggcgggguuucugucauuacacccggaacgaauaccucgaaccagguggcuguguuguaccaggacgucaauuguacugaaguuccuguggccauccacgcagaucagcugacaccaaccuggcgcguguauagcacagguuccaacguauuucaaacuagagccggcugccucaucggggcugagcaugucaacaauucauacgaaugugacauucccaucggagcgggcauuugcgcaaguuaucagacccagacgaacucuccuaggcgggcccgcagcguggcuucccagucaauaaucgccuacaccaugagccugggugcagaaaauucuguugccuacuccaacaauaguauugcuaucccaacaaacuucacuaucagcgugaccacagaaauucuucccgucucuaugacuaagaccuccguggauuguacgauguauauaugcggggacucaacagaguguaguaaucuguugcuccaauacggcagcuuuugcacccagcugaacagagccuuaacuggaaucgcaguugagcaggauaaaaauacacaggaaguguucgcgcaaguaaagcagauuuauaaaaccccgccuaucaaggacuuuggcggguucaacuuuucgcagauucugccagaucccuccaaaccuucuaagaggagcuucaucgaggaccuacucuuuaauaaggucacucuggcugaugccggauucauaaaacaauacggugacugucuuggcgauaucgcagcccgugacuugauuugcgcucagaaguucaacgggcugaccgugcugcccccacucuuaacagaugaaaugaucgcccaguauacgucagcacugcuugcuggaaccauuacgaguggcuggacauuuggugccggggcggccuugcagaucccuuucgcuaugcaaauggcauaccgguuuaauggcauaggagugacccagaacguccucuaugagaaucagaaacugauugccaaccaguucaacuccgcuaucggcaagauucaagacucucuaagcuccacagccucagcacuggggaaacuccaggacguugugaaucagaacgcgcaggcccugaauacucuuguaaagcaauugagcaguaacuuuggagcuaucucuuccgugcugaaugauauauuaagccgacucgacaaggucgaagccgaggugcagaucgauagacugauuaccggcaggcuucagucgcugcaaacguacguuacacagcaguugauccgcgcagcugagauucgggccucagcaaaccucgccgcuaccaaaaugucugaaugcgugcugggucagaguaagagagucgacuucugugggaaaggauaccaccuaauguccuuuccccaaagcgcgccacauggcgugguuuuccugcacgugacuuaugucccggcccaggagaagaauuuuaccacagcuccugcaaucugccacgaugguaaagcccauuuccccagggaaggcguauuugugucuaacgggacucacugguucguuacccagcgcaauuuuuacgagccacagauaauuacaacggacaacaccuucgugagcggaaauugugaugucgugaucggcaucguaaacaauacuguguaugacccccuccaaccugagcuggauuccuucaaggaagaacuugacaaauacuuuaagaaccauacaucaccagaugucgacuugggggauauuaguggaaucaaugccagcguugugaacauucagaaggaaauagaccgacugaaugagguggcuaaaaacuuaaacgaaucucucaucgaccugcaggagcuuggcaaguaugagcaguacauuaaauggcccugguauaucuggcuggguuucauugcagggcuaaucgccauagucauggugaccaucaugcucugcuguaugacuuccugcuguucaugccugaagggauguugcaguuguggcagcugcugcaaauuugaugaagacgauuccgagccuguuuugaaggguguaaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12962 - RNA, 4039 nt, Artificial Sequence
  SARS-CoV-2/Hong Kong/case85_VM20002868/2020__EPI_ISL_414519 spike protein mRNA human (1-1273)
aggagaaagcuuaccauguucguguuucugguccucguuccccuugugagcucccagugcguaaaccugaccacaagaacucaauugccuccagccuacacuaauucuuucaccaggggcguguauuacccggacaaggucuuucggucaaguguguuacacagcacacaggaucuguuccuacccuuuuucuccaacguuacuugguuucaugcuauccacgugucugggaccaauggaacaaaacgcuucgacaacccuguccucccauuuaaugaugguguguauuucgcaucgaccgagaagucaaacauuauacgaggcuggaucuuugggacuacacuggacagcaaaacccagagucuucugauuguaaauaacgccacgaauguugugaucaaggucugugaguuccaguuuugcaacgaucccuucuugggaguguacuaucauaaaaauaacaaguccuggauggagucugaguuccguguguacagcuccgcgaauaacuguacuuuugaauaugucucacaaccuuuccucauggaccuggaaggcaagcaggguaauuuuaaaaaccugagagaguucguuuuuaagaacauugauggguacuucaaaaucuacaguaagcacaccccaauaaaucucgugagggacuuaccccagggauuuagcgcucuggagccucuuguagauuugccaaucggcauuaacaucacacgguuccagacucugcuagcccuccaucgcucuuaucugaccccgggcgacuccucaagcggguggacagcaggagccgcugcauacuauguggguuaccuucaacccagaaccuuucuguugaaauauaaugaaaacggcacgauuacugaugccgucgacugcgcucucgauccucugagugagacaaaguguaccuuaaagucuuucacuguggaaaaagggaucuaccagacauccaauuuuaggguucagccaaccgagagcauagugcgguuccccaacauuacgaaucugugcccuuuuggagaggucuucaacgccacccgcuucgcgucgguguaugcauggaaucgaaagagaaucucuaacuguguagccgacuacuccguucucuacaauucagcuaguuuuagcacauucaaaugcuauggcguguccccaacuaaacuuaacgaccuguguuuuaccaaugucuacgccgauucuuucgugauuaggggugacgaaguccggcagaucgcacccgggcaaacaggaaagaucgcugauuauaacuacaaguugccggacgauuuuacuggcugcgugauugccuggaauagcaacaaccuagacucaaaaguuggcgggaauuauaacuaccuguaucgucucuuccgcaagaguaaucugaagccuuuugagagagauauauccaccgaaaucuaccaggcgggaagcacacccuguaacgguguggagggcuucaauugcuacuuuccacuucagucuuauggguuccaaccuaccaacggaguaggcuaccagcccuauagggucgugguucugucauuugaauugcuccacgccccagcaacugugugcggucccaaaaagaguacgaaucuggucaaaaacaagugugugaauuucaacuuuaauggguuaacaggcaccggaguacugacugagagcaacaaaaaguuccuaccuuuccagcaguuuggccgggacauugcugauaccacagacgccgugcgagauccacaaacccucgagauccuggacauaacuccgugcuccuucgggggaguuucugucauuacacccgguacgaauaccucgaaccagguggcugugcuuuaccaggacgucaauuguacugaaguuccuguggccauccacgcagaucaguugacaccaaccuggcgcguguauagcacaggcuccaacguauuucaaacuagagccgggugccugaucggagcugagcaugucaacaauucauacgaaugugacauucccaucggcgcggguauuugcgcaaguuaucagacccagacgaacucuccuaggcgggcccgcagcguggcuucccagucaauaaucgccuacaccaugagccucggggcagaaaauucuguugccuacuccaacaauaguauugcuaucccaacaaacuucacuaucagcgugaccacagaaauucugcccgucucuaugacuaagaccuccguggauuguacgauguauauaugcggcgacucaacagaguguaguaaucuucuguugcaauacggcagcuuuugcacccagcucaacagagcccugacuggaaucgcaguugagcaggauaaaaauacacaggaaguguucgcgcaaguaaagcagauuuauaaaaccccgccuaucaaggacuuugggggauucaacuuuucgcagauuuuaccagaucccuccaaaccuucuaagaggagcuucaucgaggaccugcuauuuaauaaggucacucucgcugaugccgguuucauaaaacaauacggcgacugucugggggauaucgcagcccgugaccuuauuugcgcucagaaguucaacggauugaccgugcugcccccacuccugacagaugaaaugaucgcccaguauacgucagcauuacuggcuggcaccauuacgagugguuggacauuuggggccggcgcggcccuucagaucccuuucgcuaugcaaauggcauaccgguuuaauggaauaggcgugacccagaacgucuuguaugagaaucagaaacucauugccaaccaguucaacuccgcuaucgggaagauucaagacucucugagcuccacagccucagcacuaggaaaacugcaggacguugugaaucagaacgcgcaggcccucaauacucugguaaagcaacuuagcaguaacuuuggcgcuaucucuuccguguugaaugauauacugagccgauuagacaaggucgaagccgaggugcagaucgauagacucauuaccgguaggcugcagucgcuucaaacguacguuacacagcagcugauccgcgcagcugagauucgggccucagcaaacuuggccgcuaccaaaaugucugaaugcgugcucgggcagaguaagagagucgacuucuguggaaaaggcuaccaccugauguccuuuccccaaagcgcgccacauggugugguuuuccuacacgugacuuaugucccggcccaggagaagaauuuuaccacagcuccugcaaucugccacgauggcaaagcccauuuccccagggaagggguauuugugucuaacggaacucacugguucguuacccagcgcaauuuuuacgagccacagauaauuacaacggacaacaccuucgugagcggcaauugugaugucgugaucgggaucguaaacaauacuguguaugacccccugcaaccugagcucgauuccuucaaggaggaacuggacaaauacuuuaagaaccauacaucaccagaugucgaccuuggagauauuaguggcaucaaugccagcguugugaacauucagaaggaaauagaccgauugaaugagguggcuaaaaaccugaacgaaucuuuaaucgaccuccaggagcuggguaaguaugagcaguacauuaaauggcccugguauaucuggcuuggguucauugcaggacugaucgccauagucauggugaccaucaugcuaugcuguaugacuuccugcuguucaugccucaagggcuguugcaguugugguagcugcugcaaauuugaugaagacgauuccgagccuguucugaagggcguaaaguugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12963 - RNA, 4039 nt, Artificial Sequence
  SARS-CoV-2/England/200990660/2020__EPI_ISL_414523 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgcagcccgugauuugauuugcgcucagaaguucaacggccugaccguccugcccccacucuuaacagacgaaaugaucgcccaguauacgucagcacugcuugcugguaccauuacgaguggguggacauuuggcgccggagcggccuugcagaucccuuucgcuaugcaaauggcauaccgguuuaauggcauaggggugacccagaacgugcucuaugagaaucagaaacugauugccaaccaguucaacuccgcuaucggaaagauucaagauucucuaagcuccacagccucagcacugggcaaacuccaggacgucguuaaucagaacgcgcaggcccugaauacucuugugaagcaauugagcaguaacuuuggugcuaucucuuccguacugaaugacauauuaagccgacucgauaagguggaagccgagguccagaucgacagacugauuaccgggaggcuucagucgcugcaaacguacgugacacagcaguugauccgcgcagcugagauucgggccucagcaaaccucgccgcuaccaaaaugucugaaugcguucugggacagaguaagagaguggauuucuguggcaaagguuaccaccuaauguccuuuccccaaagcgcgccacauggcgucguguuccugcacguuacuuaugugccggcccaggagaagaauuuuaccacagcuccugcaaucugccacgacgggaaagcccauuuccccagggaaggagucuuuguaucuaacggcacucacugguucgugacccagcgcaauuuuuacgagccacagauaauuacaacggauaacaccuucguuagcgggaauugugacguggucaucggaaucgugaacaauacuguauaugauccccuccaaccugagcuggacuccuucaaggaagaacuugauaaauacuuuaagaaccauacaucaccagacguggauuugggcgacauuagugguaucaaugccagcgucguuaacauucagaaggaaauagaucgacugaaugagguggcuaaaaacuuaaacgaaucucucaucgaccugcaggagcuugggaaguaugagcaguacauuaaauggcccugguauaucuggcugggauucauugcaggccuaaucgccauagugauggucaccaucaugcucugcuguaugacuuccugcuguucaugccugaaggguuguugcaguuguggcagcugcugcaaauuugacgaagaugacuccgaguuggugcugaaggggguuaaguuacacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12964 - RNA, 4039 nt, Artificial Sequence
  SARS-CoV-2/Australia/NSW09/2020__EPI_ISL_413595 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacaggaaguuuucgcgcaagugaagcagauuuauaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauacggcgacugucuuggggauaucgcagcccgugacuugauuugcgcucagaaguucaacggacugaccguccuacccccacuguuaacagaugaaaugaucgcccaguauacgucagcacugcuugcuggcaccauuacgagugguuggacauuuggggccggcgcggccuugcagaucccuuucgcuaugcaaauggcauaccgguuuaauggaauaggcgugacccagaacgugcucuaugagaaucagaaacugauugccaaccaguucaacuccgcuaucgggaagauucaagacucucucagcuuuacagccuccgcacugggaaaacuccaggacgucguuaaucagaacgcgcaggcccugaauacucuugugaagcaauugucaagcaacuucggcgcuaucaguucuguacugaaugauauauuaucccgacucgacaagguggaagccgagguccagaucgauagacugauuaccgguaggcuucagagccugcaaacguacgugacacagcaguugauccgcgcagcugagauucgggccucggcaaaccucgccgcuaccaaaaugucagaaugcguucuggggcagucuaagagaguggacuuuuguggaaaaggcuaccaccuaaugaguuucccccaauccgcgccacauggugucguguuucugcacguuacuuaugugccggcccaggagaagaauuucaccacagcuccugcaaucugccacgauggcaaagcccauuuucccagggaaggggucuucguaagcaacggaacucacugguuugugacccagcgcaauuucuacgagccacagauaauuacaacggacaacaccuucguuucuggcaauugugauguggucaucgggaucgugaacaauacuguauaugacccccuccaaccugagcuggauagcuuuaaggaggaacuugacaaauacuucaagaaccauacauccccagauguggacuugggagauauuucaggcaucaaugccagugucguuaacauucagaaggaaauagaccgacugaaugagguggcuaaaaacuuaaacgaaagccucaucgaccugcaggagcuugguaaguaugagcaguacauuaaauggcccugguauaucuggcugggguuuauugcaggacuaaucgccauagugauggucaccaucaugcucugcuguaugacuucuugcuguuccugccugaagggcuguugcucaugugguaguugcugcaaauucgaugaagacgauagcgagccuguguugaagggcguuaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12965 - RNA, 4039 nt, Artificial Sequence
  SARS-CoV-2/Australia/NSW10/2020__EPI_ISL_413596 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacaggaaguuuucgcgcaagugaagcagauuuauaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauacggcgacugucuuggggauaucgcagcccgugacuugauuugcgcucagaaguucaacggacugaccguccugcccccacucuuaacagaugaaaugaucgcccaguauacgucagcacugcuugcuggcaccauuacgagugguuggacauuuggggccggcgcggccuugcagaucccuuucgcuaugcaaauggcauaccgguuuaauggaauaggcgugacccagaacgugcucuaugagaaucagaaacugauugccaaccaguucaacuccgcuaucgggaagauucaagacucucuaagcuccacagccucagcacugggaaaacuccaggacgucguuaaucagaacgcgcaggcccugaauacucuugugaagcaauugagcaguaacuuuggcgcuaucucuuccguacugaaugauauauuaagccgacucgacaagguggaagccgagguccagaucgauagacugauuaccgguaggcuucagucgcugcaaacguacgugacacagcaguugauccgcgcagcugagauucgggccucagcaaaccucgccgcuaccaaaaugucugaaugcguucuggggcagaguaagagaguggacuucuguggaaaaggcuaccaccuaauguccuuuccccaaagcgcgccacauggugucguguuccugcacguuacuuaugugccggcccaggagaagaauuuuaccacagcuccugcaaucugccacgauggcaaagcccauuuccccagggaaggggucuuuguaucuaacggaacucacugguucgugacccagcgcaauuuuuacgagccacagauaauuacaacggacaacaccuucguuagcggcaauugugauguggucaucgggaucgugaacaauacuguauaugacccccuccaaccugagcuggauuccuucaaggaggaacuugacaaauacuuuaagaaccauacaucaccagauguggacuugggagauauuaguggcaucaaugccagcgucguuaacauucagaaggaaauagaccgacugaaugagguggcuaaaaacuuaaacgaaucucucaucgaccugcaggagcuugguaaguaugagcaguacauuaaauggcccugguauaucuggcugggguucauugcaggacuaaucgccauagugauggucaccaucaugcucugcuguaugacuuccugcuguucaugccugaagggcuguugcaguugugguagcugcuuuaaauucgaugaagacgauuccgagccuguguugaagggcguuaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12966 - RNA, 4039 nt, Artificial Sequence
  SARS-CoV-2/Switzerland/1000477797/2020__EPI_ISL_413023 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaauaucuacaguaaacacaccccaauaaacuuaguuagggaccugccccagggauuuagcgcucuugagccuuugguggaucugccaaucggcauuaauaucacacgguuccagacucuacucgcccugcaucgcucuuaucuuaccccgggcgacuccucaagcggguggacagcaggagccgcugcauacuauguagguuaccugcaacccagaaccuuuuugcucaaguauaacgaaaauggcacgauuacugaugccguggacugcgcucuggauccuuuaagugagacaaaauguacccugaagucuuucacugucgaaaaggggaucuaccagacauccaacuuuagggugcagccaaccgagagcauaguucgguuccccaauauuacgaaccucugcccuuuuggagagguguucaaugccacccgcuucgcgucggucuaugcauggaaccgaaaaagaaucucuaauuguguggccgacuacuccguacuuuacaacucagcuaguuuuagcacauucaagugcuauggcguuuccccaacuaaacugaaugacuuguguuuuaccaacguguacgccgauucuuucgucauuaggggugacgaagugcggcagaucgcacccgggcaaacaggaaagaucgcugauuauaauuacaaacuaccggacgauuuuacuggcugcgucauugccuggaacagcaacaaucuggacucaaaggugggcgggaacuauaauuaccucuaucgucuguuccgcaaaaguaaccuuaagccuuuugagagagauauauccaccgaaaucuaccaggcgggaagcacacccuguaaugguguugagggcuucaacugcuacuuuccacugcagucuuauggguuccaaccuaccaauggagugggcuaccagcccuauaggguagucguguugucauuugaacuccugcacgccccagcaacuguuugcggucccaagaaaaguacgaacuuagugaagaauaaaugugucaacuucaauuuuaacgggcugacaggcaccggagugcuaacugagagcaauaagaaauuccucccuuuccagcaguuuggccgggacauugcugauaccacagacgccguacgagauccacaaacccuggagauccuugacauaacuccgugcuccuucgggggagugucuguuauuacacccgguacgaacaccucgaaucaggucgcuguguuguaccagggcgugaacuguacugaagucccuguugccauccacgcagaccagcugacaccaaccuggcgcguguauagcacaggguccaacguguuucaaacuagagccggaugccucaucggcgcugagcauguaaauaacucauacgaaugugauauucccaucggugcggggauuugcgcaaguuaucagacccagaccaauucuccuaggcgggcccgcagcgucgcuucccagucaauaaucgccuacacgaugagccugggcgcagagaacucuguggccuacuccaauaacaguauugcuaucccaacaaauuucacuaucagcguuaccacagaaauucuucccgugucuaugacuaagaccuccgucgacuguacgauguauauaugcggagauucaacagaguguaguaaccuguugcuccaauacggcagcuuuugcacccagcugaauagagccuuaacugggaucgcaguggagcaggacaagaacacacaggaaguuuucgcgcaagugaaacagauuuauaagaccccgccuaucaaagauuuuggagguuucaauuuuucgcagauucugccagaccccuccaagccuucuaaaaggagcuucaucgaggaucuacucuuuaacaagguaacucuggcugacgccggcuucauaaagcaauacggggauugucuuggagacaucgcagcccgugauuugauuugcgcucagaaauucaauggccugaccguccugcccccacucuuaacagacgaaaugaucgcccaguauacgucagcacugcuugcugguaccauuacgaguggguggacauuuggcgccggagcggccuugcagaucccuuucgcuaugcaaauggcauaccgguuuaacggcauaggggugacccagaaugugcucuaugagaaccagaagcugauugccaaccaguucaauuccgcuaucggaaaaauucaagauucucuaagcuccacagccucagcacugggcaagcuccaggacgucguuaaccagaaugcgcaggcccugaacacucuugugaaacaauugagcaguaauuuuggugcuaucucuuccguacugaacgacauauuaagccgacucgauaagguggaagccgagguccagaucgacagacugauuaccgggaggcuucagucgcugcaaacguacgugacacagcaguugauccgcgcagcugagauucgggccucagcaaaucucgccgcuaccaagaugucugaaugcguucugggacagaguaaaagaguggauuucuguggcaaggguuaccaccuaauguccuuuccccaaagcgcgccacauggcgucguguuccugcacguuacuuaugugccggcccaggagaaaaacuuuaccacagcuccugcaaucugccacgacgggaaggcccauuuccccagggaaggagucuuuguaucuaauggcacucacugguucgugacccagcgcaacuuuuacgagccacagauaauuacaacggauaauaccuucguuagcgggaacugugacguggucaucggaaucgugaauaacacuguauaugauccccuccaaccugagcuggacuccuucaaagaagaacuugauaaguacuuuaaaaaucauacaucaccagacguggauuugggcgacauuagugguaucaacgccagcgucguuaauauucagaaggaaauagaucgacugaacgagguggcuaagaacuuaaaugaaucucucaucgaccugcaggagcuugggaaauaugagcaguacauuaaguggcccugguauaucuggcugggauucauugcaggccuaaucgccauagugauggucaccaucaugcucugcuguaugacuuccugcuguucaugccugaaagguuguugcaguuguggcagcugcugcaaguuugacgaagaugacuccgagccuguguugaaagggguuaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12967 - RNA, 4039 nt, Artificial Sequence
  SARS-CoV-2/Belgium/BA-02291/2020__EPI_ISL_415159 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcagaaguaaucuuaagccuuuugagagggauauauccaccgaaaucuaccaggcgggaagcacacccuguaacgguguugagggcuucaauugcuacuuuccacugcagucuuauggguuccaaccuaccaacggagugggcuaccagcccuaucggguagucguguugucauuugaacuccugccagcccccgcaacuguuugcgguccuaagaaaaguacgaauuuagugaagaacaaaugugucaauuucaacuuuaaugggcugacaggcaccggagugcuaacugagagcaacaagaaauuccucccauuccagcaguuuggccgagacauugcugauaccacagacgccguacgcgauccgcaaacccuggagauccuugacauaacucccugcuccuucgggggagugucuguuauuacaccugguacgaauaccucgaaccaggucgcuguguuguaccagggcgugaauuguacugaagucccaguugccauccacgcagaccagcugacacccaccuggagaguguauagcacaggguccaacguguuucaaacuagggccggaugccucaucggcgcugagcacguaaacaauucauacgaaugugauauuccuaucggugcggggauuugcgcaaguuaucagacccagacgaacucuccacggcgcgccagaagcgucgcuucccagucaauaaucgccuacaccaugagccugggcgcagaaaauucuguggccuacuccaacaauaguauugcuauccccacaaacuucacuaucagcguuaccacagaaauucuuccggugucuaugacuaagaccuccgucgacuguacgauguauauaugcggagauucaacagaguguaguaaucuguugcuccaauacggcagcuuuugcacccagcugaacagggccuuaacugggaucgcaguggagcaggacaagaauacacaggaaguuuucgcgcaagugaaacagauuuauaagaccccuccaaucaaagauuuuggagguuucaacuuuucgcagauucugcccgacccuuccaagcccucuaaacguagcuucaucgaggaucuacucuuuaauaagguaacucuggcugacgccggcuucauaaagcaauacggggauugucuuggagacaucgcagcccgggauuugauuugcgcucagaaauucaacggccugaccguccucccaccucuguuaacagacgaaaugaucgcccaguauacgucagcacugcuugcugguaccauuacgaguggguggacauuuggcgccggagcggccuugcagauccccuucgcuaugcaaauggcauaccgauuuaauggcauaggggugacccagaacgugcucuaugagaaucagaagcugauugccaaccaguucaacuccgcuaucggaaaaauucaagauucucuaagcuccgccgcaccagcgcugggcaagcuccaggacgucguuaaucagaacgcccaggcucugaauacacuugugaaacaauugucaagcaacuuuggugccaucaguucuguacugaaugacauauuauccagacucgauaagguggaagcagagguccagaucgacaggcugauuacugggcgccuucagagccugcaaaccuacgugacgcagcaguugauccgggcugccgagauuagagcaucggccaaccucgcugcgacaaagaugucagaaugcguucugggacagucuaaaaggguggauuucuguggcaaggguuaccaucuaaugaguuuuccgcaauccgccccucacggcgucguguuccugcauguuaccuaugugcccgcacaggagaaaaauuuuacuaccgcuccagccaucugccacgacgggaaggcccacuucccccgcgaaggagucuuuguaagcaacggcacacauugguucgugacucagcgaaauuuuuacgagccucagauaauuaccacagauaacacguucguuucugggaauugugacguggucaucggaaucgugaacaauaccguauaugauccacuccaacccgagcuggacagcuucaaagaagaacuugauaaguacuuuaaaaaccacacuuccccugacguggauuugggcgacauuucagguaucaaugcuagugucguuaacauucagaaggaaauagaucggcugaaugagguggcaaagaacuuaaacgaaagccucaucgaccugcaggagcuugggaaauaugagcaguacauuaaguggccgugguauaucuggcugggauucauugccggccuaaucgcgauagugauggucacaaucaugcucugcuguaugaccucuugcuguuccugccugaaagguuguugcucauguggcaguugcugcaaguuugacgaagaugacagcgagccaguguugaaagggguuaagcugcauuacacuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12968 - RNA, 4039 nt, Artificial Sequence
  SARS-CoV-2/USA/WA8-UW5/2020__EPI_ISL_413486 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugaguacguaaacaauucauaugaaugugacauucccaucggcgcggguauuugcgcaaguuaccagacccagacgaacucuccuaggcgggcccgcagcgucgcuucccagucaauaaucgccuacaccaugagccugggggcagaaaauucuguggccuauuccaacaauaguauugcuaucccaacaaacuucacuaucagcguuaccacagaaauucuucccgugucuaugacuaagaccuccgucgauuguacgauguacauaugcggcgacucaacagaguguaguaaucuguugcuccaauauggcagcuuuugcacccagcugaacagagccuuaacuggaaucgcaguggagcaggauaaaaauacacaggaaguuuucgcgcaagugaagcagauuuacaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauauggcgacugucuuggggauaucgcagcccgugacuugauuugcgcucagaaguucaacggacugaccguccugcccccacucuuaacagaugaaaugaucgcccaguacacgucagcacugcuugcuggcaccauuacgagugguuggacauuuggggccggcgcggccuugcagaucccuuucgcuaugcaaauggcauaucgguuuaauggaauaggcgugacccagaacgugcucuacgagaaucagaaacugauugccaaccaguucaacuccgcuaucgggaagauucaagacucucuaagcuccacagccucagcacugggaaaacuccaggacgucguuaaucagaacgcgcaggcccugaauacucuugugaagcaauugagcaguaacuuuggcgcuaucucuuccguacugaaugauauauuaagccgacucgacaagguggaagccgagguccagaucgauagacugauuaccgguaggcuucagucgcugcaaacguacgugacacagcaguugauccgcgcagcugagauucgggccucagcaaaccucgccgcuaccaaaaugucugaaugcguucuggggcagaguaagagaguggacuucuguggaaaaggcuaucaucuaauguccuuuccccaaagcgcgccacacggugucguguuccugcauguuacuuacgugccggcccaggagaagaauuuuaccacagcuccugcaaucugccacgauggcaaagcccacuuccccagggaaggggucuuuguaucuaacggaacucauugguucgugacccagcgcaauuuuuaugagccacagauaauuacaacggacaacaccuucguuagcggcaauugugauguggucaucgggaucgugaacaauacuguauacgacccccuccaaccugagcuggauuccuucaaggaggaacuugacaaauauuuuaagaaccacacaucaccagauguggacuugggagauauuaguggcaucaaugccagcgucguuaacauucagaaggaaauagaccgacugaaugagguggcuaaaaacuuaaacgaaucucucaucgaccugcaggagcuugguaaguacgagcaguauauuaaauggcccugguacaucuggcugggguucauugcaggacuaaucgccauagugauggucaccaucaugcucugcuguaugacuuccugcuguucaugccugaagggcuguugcaguugugguagcugcugcaaauuugaugaagacgauuccgagccuguguugaagggcguuaagcugcauuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12969 - RNA, 4039 nt, Artificial Sequence
  SARS-CoV-2/England/20102000506/2020__EPI_ISL_415147 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggguauugucuuggagauaucgcagcccgugacuugauuugcgcucagaaguucaacggccugaccguccugcccccacucuuaacagaugaaaugaucgcccaguacacgucagcacugcuugcugguaccauuacgaguggguggacauuuggcgccggagcggccuugcagaucccuuucgcuaugcaaauggcauaucgguuuaauggcauaggggugacccagaacgugcucuacgagaaucagaaacugauugccaaccaguucaacuccgcuaucggaaagauucaagacucucuaagcuccacagccucagcacugggcaaacuccaggaugucguuaaucagaacgcgcaggcccugaauacucuugugaagcaauugagcaguaacuuuggugcuaucucuuccguacugaaugacauauuaagccgacucgacaagguggaagccgagguccagaucgauagacugauuaccgggaggcuucagucgcugcaaacguacgugacacagcaguugauccgcgcagcugagauucgggccucagcaaaccucgccgcuaccaaaaugucugaaugcguucugggacagaguaagagaguggacuucuguggcaaagguuaucaccuaauguccuuuccccaaagcgcgccacauggcgucguguuccugcacguuacuuacgugccggcccaggagaagaauuuuaccacagcuccugcaaucugccacgaugggaaagcccauuuccccagggaaggagucuuuguaucuaacggcacucacugguucgugacccagcgcaauuuuuaugagccacagauaauuacaacggacaacaccuucguuagcgggaauugugauguggucaucggaaucgugaacaauacuguauacgacccccuccaaccugagcuggauuccuucaaggaagaacuugacaaauauuuuaagaaccauacaucaccagauguggacuugggcgauauuagugguaucaaugccagcgucguuaacauucagaaggaaauagaccgacugaaugagguggcuaaaaacuuaaacgaaucucucaucgaucugcaggagcuugggaaguacgagcaguauauuaaauggcccugguacaucuggcugggauucauugcaggccuaaucgccauagugauggucaccaucaugcucugcuguaugacuuccugcuguucaugccugaaggguuguugcaguuguggcagcugcugcaaauuugacgaagacgauuccgagccuguguugaaggggguuaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12970 - RNA, 4039 nt, Artificial Sequence
  SARS-CoV-2/Belgium/VAG-03013/2020__EPI_ISL_415155 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgcagcccgugauuugauuugcgcucagaaguucaacggccugaccguccugcccccacucuuaacagacgaaaugaucgcccaguauacgucagcacugcuugcugguaccauuacgaguggguggacauuuggcgccggagcggccuugcagaucccuuucgcuaugcaaauggcauaccgguuuaauggcauaggggugacccagaacgugcucuaugagaaucagaaacugauugccaaccaguucaacuccgcuaucggaaagauucaagauucucuaagcuccacagccacugcacugggcaaacuccaggacgucguuaaucagaacgcgcaggcccugaauacccuugugaagcaauugucaagcaacuuuggugcuaucaguucuguacugaaugacauauuaucccgacucgauaagguggaagccgagguccagaucgacagacugauuacggggaggcuucagagccugcaaacauacgugacccagcaguugauccgcgcagcugagauucgggccucggcaaaccucgccgcuacuaaaaugucagaaugcguucugggacagucuaagagaguggauuucuguggcaaagguuaccaccuaaugaguuuuccccaauccgcgccacauggcgucguguuccugcacguuaccuaugugccggcccaggagaagaauuuuacaacugcuccugcaaucugccacgacgggaaagcccauuuccccagggaaggagucuuuguaagcaacggcacccacugguucgugacacagcgcaauuuuuacgagccacagauaauuacgaccgauaacacuuucguuucugggaauugugacguggucaucggaaucgugaacaauacaguauaugauccccuccaaccugagcuggacagcuucaaggaagaacuugauaaauacuuuaagaaccauaccuccccagacguggauuugggcgacauuucagguaucaaugccagugucguuaacauucagaaggaaauagaucgacugaaugagguggcuaaaaacuuaaacgaaagccucaucgaccugcaggagcuugggaaguaugagcaguacauuaaauggcccugguauaucuggcugggauucauugcaggccuaaucgccauagugauggucacuaucaugcucugcuguaugacaucuugcuguuccugccugaaggguuguugcucauguggcaguugcugcaaauuugacgaagaugacagcgagccuguguugaaggggguuaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12971 - RNA, 4039 nt, Artificial Sequence
  SARS-CoV-2/Belgium/BC-03016/2020__EPI_ISL_415157 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgcagcccgugauuugauuugcgcucagaaguucaacggccugaccguccugcccccacucuuaacagacgaaaugaucgcccaguauacgucagcacugcuugcugguaccauuacgaguggguggacauuuggcgccggagcggccuugcagaucccuuucgcuaugcaaauggcauaccgguuuaauggcauaggggugacccagaacgugcucuaugagaaucagaaacugauugccaaccaguucaacuccgcuaucggaaagauucaagauucucuaagcuccacagcccccgcacugggcaaacuccaggacgucguuaaucagaacgcgcaggcccugaauacucuugugaagcaauugucaagcaacuuuggugcuaucaguucuguacugaaugacauauuaucccgacucgauaagguggaagccgagguccagaucgacagacugauuaccgggaggcuucagagccugcaaacguacgugacacagcaguugauccgcgcagcugagauucgggccucggcaaaccucgccgcuaccaaaaugucagaaugcguucugggacagucuaagagaguggauuucuguggcaaagguuaccaccuaaugaguuuuccacaauccgcgccgcauggcgucguguuccugcacguuacuuaugugccugcccaggagaagaauuuuaccacagcacccgcuaucugccacgacgggaaagcccauuucccaagggaaggagucuuuguaagcaacggcacucacugguucgugacccagcgcaauuuuuacgagccccagauaauuacaacggauaacaccuucguuucugggaauugugacguggucaucggaaucgugaacaauacuguauaugauccucuccaaccagagcuggacagcuucaaggaagaacuugauaaauacuuuaagaaccauacaucccccgacguggauuugggcgacauuucagguaucaaugccagugucguuaacauucagaaggaaauagaucgacugaaugagguggcuaaaaacuuaaacgaaagccucaucgaccugcaggagcuugggaaguaugagcaguacauuaaauggccuugguauaucuggcugggauucauugcaggccuaaucgccauagugauggucaccaucaugcucugcuguaugacuucuugcuguuccugccugaaggguuguugcucauguggcaguugcugcaaauuugacgaagaugacagcgagccgguguugaaggggguuaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12972 - RNA, 4039 nt, Artificial Sequence
  SARS-CoV-2/Germany/BavPat3/2020__EPI_ISL_414521 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacagcaaguuuucgcacaggugaagcagauuuauaaaaccccgccuaucaaggacuuugggggauucaacuuuucgcaaauucugccagaucccuccaaaccuucuaagaggagcuucaucgaagaccuacucuuuaauaagguaacucuggcugaugccgguuucauaaaacaguacggcgacugucuuggggauaucgcagcccgugacuugauuugcgcucagaaguucaacggacugaccguccugcccccacucuuaacagaugagaugaucgcccaguauacgucagcacugcuugcuggcaccauuacgagugguuggacauuuggggccggcgcggccuugcaaaucccuuucgcuaugcagauggcauaccgguuuaauggaauaggcgugacccagaacgugcucuaugaaaaucagaaacugauugccaaccaauucaacuccgcuaucgggaagauucaggacucucuaagcuccacagccucagcacugggaaaacuccaggacgucguuaaucagaacgcgcaagcccugaauacucuugugaagcaguugagcaguaacuuuggcgcuaucucuuccguacugaaugauauauuaagccgacucgacaagguggaggccgaaguccagaucgauagacugauuaccgguaggcuucaaucgcugcagacguacgugacacagcaguugauccgcgcagcugagauucgggccucagcaaaccucgccgcuaccaaaaugucugagugcguucuggggcaaaguaagagaguggacuucuguggaaaaggcuaccaccuaauguccuuuccccagagcgcgccacauggugucguguuccugcacguuacuuaugugccggcccaggaaaagaauuuuaccacagcgccugcuaucugccacgauggcaaagcccauuuccccagggagggggucuuuguaucuaacggaacucacugguucgugacccagcgcaauuuuuacgaaccacaaauaauuacaacggacaacaccuucguuagcggcaauugugauguggucaucgggaucgugaacaauacuguauaugacccccuccagccugagcuggauuccuucaaggaggaacuugacaaauacuuuaagaaccauacaucaccagauguggacuugggagauauuaguggcaucaaugccagcgucguuaacauucagaaggagauagaccgacugaaugaaguggcuaaaaacuuaaacgagucucucaucgaccugcaggaacuugguaaguaugagcaauacauuaaauggcccugguauaucuggcugggguucauugcaggacuaaucgccauagugauggucaccaucaugcucugcuguaugacuuccugcuguucaugccugaagggcuguugcaguugugguagcugcugcaaauuugaugaggacgauuccgaaccuguguugaagggcguuaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12973 - RNA, 4039 nt, Artificial Sequence
  SARS-CoV-2/France/HF1805/2020__EPI_ISL_414628 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgcagcccgugauuugauuugcgcucagaaguucaacggccugaccguccugcccccacucuuaacagacgaaaugaucgcccaguauacgucagcacugcuugcugguaccauuacgaguggguggacauuuggcgccggagcggccuugcagaucccuuucgcuaugcaaauggcauaccgguuuaauggcauaggggugacccagaacgugcucuaugagaaucagaaacugauugccaaccaguucaacuccgcuaucggaaagauucaagauucucuaagcuccacagccucagcacugggcaaacuccaggacgucguuaaucagaacgcgcaggcccugaauacucuugugaagcaauugagcaguaacuuuggugcuaucucuuccguacugaaugacauauuaagccgacucgauaagguggaagccgagguccagaucgacagacugauuaccgggaggcuucagucgcugcaaacguacgugacacagcaguugauccgcgcagcugagauucgggccucagcaaaccucgccgcuaccaaaaugucugaaugcguucugggacagaguaagagaguggauuucuguggcaaagguuaccaccuaauguccuuuccccaaagcgcgccacauggcgucguguuccugcacguuacuuaugugccggcccaggagaagaauuuuaccacagcuccugcaaucugccacgacgggaaagcccauuuccccagggaaggagucuuuguaucuaacggcacucacugguucgugacccagcgcaauuuuuacgagccacagauaauuacaacggauaacaccuucguuagcgggaauugugacguggucaucggagugguaaacaauacuguguaugauccccuccaaccugagcuggacuccuucaaggaagaacuugauaaauacuuuaagaaccauacaucaccagacgucgauuugggcgacaucagugguauuaaugccagcguugugaacauccagaaggaaauugaucgacugaaugagguggcuaaaaacuuaaacgaaucucucauagaccugcaggagcuugggaaguaugagcaguacaucaaauggcccugguauauuuggcugggauucaucgcaggccuaauugccaucgucauggugaccauaaugcucugcuguaugacuuccugcuguucaugccugaaggguuguugcaguuguggcagcugcugcaaauuugacgaagaugacuccgagccuguuuugaaggggguaaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12974 - RNA, 4039 nt, Artificial Sequence
  SARS-CoV-2/Netherlands/ZuidHolland_9/2020__EPI_ISL_414445 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgcagcccgugauuugauuugcguccagaaguucaacggccugaccgugcugcccccacucuuaacagacgaaaugaucgcucaguauacgucagcccugcuugcagguaccauuacgaguggguggacauuuggcgcuggagccgcguugcagaucccuuucgccaugcaaauggcuuaccgguuuaauggcauaggggugacccagaacguccucuaugagaaucagaaacugauugcaaaccaguucaacuccgccaucggaaagauucaagauucucuaagcuccacagcuucagcccugggcaaacuccaggacguugugaaucagaacgcacaggcgcugaauacucuuguaaagcaauugagcaguaacuuuggugccaucucuuccgugcugaaugacauauuaagccgacucgauaaggucgaagcugaggugcagaucgacagacugauuaccgggaggcuucagucgcugcaaacguacguuacacagcaguugauccgcgccgcagagauucgggcuucagccaaccucgcagccaccaaaaugucugaaugcgugcugggacagaguaagagagucgauuucuguggcaaagguuaccaccuaauguccuuuccccaaagcgcuccacauggcgugguuuuccugcacgugacuuaugucccggcgcaggagaagaauuuuaccacagccccugcaaucugccacgacgggaaagcucauuuccccagggaaggaguauuugugucuaacggcacucacugguucguuacccagcgcaauuuuuacgagccacagauaauuacaacggauaacaccuucgugagcgggaauugugacgucgugaucggaaucguaaacaauacuguguaugauccccuccaaccugagcuggacuccuucaaggaagaacuugauaaauacuuuaagaaccauacaucaccagacgucgauuugggcgacauuagugguaucaaugccagcguugugaacauucagaaggaaauagaucgacugaaugagguggccaaaaacuuaaacgaaucucucaucgaccugcaggagcuugggaaguaugagcaguacauuaaauggcccugguauaucuggcugggauucauugcuggccuaaucgcaauagucauggugaccaucaugcucugcuguaugacuuccugcuguucaugccugaaggguuguugcaguuguggcagcugcugcaaauuugacgaagaugacuccgagccuguuuugaaggggguaaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12975 - RNA, 4039 nt, Artificial Sequence
  SARS-CoV-2/Finland/FIN03032020A/2020__EPI_ISL_413602 spike protein mRNA human (1-1273)
aggagaaagcuuaccauguucguguuucugguccuccuuccccugguuagcucccagugcgugaacuugaccacaagaacucaauuaccuccagccuacaccaauucuuucacgaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauuagcuggaacucaaauaaccuggacaguaaagugggcgggaauuauaacuaccucuaucgucuguuccgcaaguccaaucuuaagccuuuugagagagauauaagcaccgaaaucuaccaggccggaucuacacccuguaacgguguugagggcuucaauugcuacuuuccacugcagucauauggguuccaaccuaccaacggagugggcuaccagcccuauaggguagucguguugaguuuugaacuccugcacgcgccagccacuguuugcggucccaaaaagagcacgaauuuagugaaaaacaagugugucaauuucaacuuuaaugggcugacaggcaccggagugcuaacugaguccaacaaaaaguuccucccuuuccagcaguuuggccgggacauugcagauaccacagacgcuguacgagauccacaaacccuggagauccuugacauaacuccgugcucuuucgggggagugucgguuauuacacccgguacgaauaccagcaaccaggucgccguguuguaccagggcgugaauuguacugaagucccuguugcuauccacgccgaccagcugacaccaaccuggcgcguguauuccacagggucaaacguguuucaaacuagagcaggaugccucaucggcgccgagcauguaaacaauaguuacgaaugugauauucccaucggugcugggauuugcgcgucuuaucagacccagacgaacagcccuaggcgggcacgcuccgucgccucacagagcauaaucgcuuacaccaugucucugggcgccgaaaauuccguggcauacaguaacaauagcauugccaucccaacaaacuucacuaucucuguuaccacagaaauucuucccguguccaugacuaagaccucagucgacuguacgauguauauaugcggagauaguacagaguguagcaaucuguugcuccaauacggcucguuuugcacccagcugaacagagcuuuaacugggaucgccguggagcaggacaaaaauacacaggaaguuuucgcacaagugaagcagauuuauaaaaccccgccuaucaaggauuuuggagguuucaacuuuucccagauucugccagaccccucuaaaccuagcaagaggucauucaucgaggaucuacucuuuaauaagguaacucuggcggacgcuggcuucauaaaacaauacggggauugucuuggagacaucgccgcacgugauuugauuugcgcccagaaguucaacggccugaccguccugcccccacucuuaacagacgaaaugaucgcucaguauacgagugcccugcuugcagguaccauuacuuccggguggacauuuggcgcuggagccgcguugcagaucccuuucgccaugcaaauggcuuaccgguuuaauggcauaggggugacccagaacgugcucuaugagaaucagaaacugauugcaaaccaguucaacucugccaucggaaagauucaagauagccuauccucaacagcuagcgcccugggcaaacuccaggacgucguuaaucagaacgcacaggcgcugaauacucuugugaagcaauugaguucuaacuuuggugccaucuccagcguacugaaugacauauuaucgcgacucgauaagguggaagcugagguccagaucgacagacugauuaccgggaggcuucagucacugcaaacguacgugacacagcaguugauccgcgccgcagagauucgggcuucugccaaccucgcagccaccaaaaugagugaaugcguucugggacaguccaagagaguggauuucuguggcaaagguuaccaccuaaugagcuuuccccaaucugcuccacauggcgucguguuccugcacguuacuuaugugccggcgcaggagaagaauuuuaccacagccccugcaaucugccacgacgggaaagcucauuuccccagggaaggagucuuuguaagcaacggcacucacugguucgugacccagcgcaauuuuuacgagccacagauaauuacaacggauaacaccuucguuuccgggaauugugacguggucaucggaaucgugaacaauacuguauaugauccccuccaaccugagcuggacucauucaaggaagaacuugauaaauacuuuaagaaccauacaaguccagacguggauuugggcgacauuagcgguaucaaugccucugucguuaacauucagaaggaaauagaucgacugaaugagguggccaaaaacuuaaacgaaucccucaucgaccugcaggagcuugggaaguaugagcaguacauuaaauggcccugguauaucuggcugggauucauugcuggccuaaucgcaauagugauggucaccaucaugcucugcuguaugacuucaugcuguaguugccugaaggguuguugcagcuguggcuccugcugcaaauuugacgaagaugacucugagccuguguugaaggggguuaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12976 - RNA, 4039 nt, Artificial Sequence
  SARS-CoV-2/France/GE1977/2020__EPI_ISL_414632 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgcagcccgugauuugauuugcgcucagaaguucaacggccugaccguccugcccccacucuuaacagacgaaaugaucgcccaguauacgucagcacugcuugcugguaccauuacgaguggguggacauuuggcgccggagcggccuugcagaucccuuucgcuaugcaaauggcauaccgguuuaauggcauaggggugacccagaacgugcucuaugagaaucagaaacugauugccaaccaguucaacuccgcuaucggaaagauucaagauucucuauuuagcacagccuccgcacugggcaaacuccaggacgucguuaaucagaacgcgcaggcccugaauacucuugugaagcaauugucaagcaacuucggugcuaucaguucuguacugaaugacauauuaucccgacucgauaagguggaagccgagguccagaucgacagacugauuaccgggaggcuucagagccugcaaacguacgugacacagcaguugauccgcgcagcugagauucgggccucggcaaaccucgccgcuaccaaaaugucagaaugcguucugggacagucuaagagaguggauuuuuguggcaaagguuaccaccuaaugaguuucccccaauccgcgccacauggcgucguguuucugcacguuacuuaugugccggcccaggagaagaauuucaccacagcuccugcaaucugccacgacgggaaagcccauuuucccagggaaggagucuucguaagcaacggcacucacugguuugugacccagcgcaauuucuacgagccacagauaauuacaacggauaacaccuucguuucugggaauugugacguggucaucggaaucgugaacaauacuguauaugauccccuccaaccugagcuggacagcuuuaaggaagaacuugauaaauacuucaagaaccauacauccccagacguggauuugggcgacauuucagguaucaaugccagugucguuaacauucagaaggaaauagaucgacugaaugagguggcuaaaaacuuaaacgaaagccucaucgaccugcaggagcuugggaaguaugagcaguacauuaaauggcccugguauaucuggcugggauuuauugcaggccuaaucgccauagugauggucaccaucaugcucugcuguaugacuucuugcuguuccugccugaaggguuguugcucauguggcaguugcugcaaauucgacgaagaugacagcgagccuguguugaaggggguuaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12977 - RNA, 4039 nt, Artificial Sequence
  SARS-CoV-2/Finland/FIN-313/2020__EPI_ISL_414641 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguucaaaacucuacucgcccugcaucgcucuuaucuuaccccgggcgacuccucaagcggguggacagcaggagccgcugcauacuauguagguuaccugcagcccagaaccuuuuugcucaaguauaaugaaaacggcacgauuacugaugccguggacugcgcucuggauccuuuaagugagacaaaguguacccugaaaucuuucacugucgaaaaggggaucuaccaaacauccaauuuuagggugcagccaaccgagagcauaguucgguuccccaacauuacgaaucucugcccuuuuggagagguguucaacgccacccgcuucgcgucggucuaugcauggaaucgaaaaagaaucucuaacuguguggccgacuacuccguacuuuacaauucagcuaguuuuagcacauucaagugcuauggcguuuccccaacuaaacugaacgacuuguguuuuaccaauguguacgccgauucuuucgucauuaggggugacgaagugcggcagaucgcacccgggcagacaggaaagaucgcugauuauaacuacaaacuaccggacgauuuuacuggcugcgucauugccuggaauagcaacaaccuggacucaaaggugggcgggaauuauaacuaccucuaucgucuguuccgcaagaguaaucuuaaaccuuuugagagagauauauccaccgaaaucuaccaagcgggaagcacacccuguaacgguguugagggcuucaauugcuacuuuccacugcagucuuauggguuccagccuaccaacggagugggcuaccaacccuauaggguagucguguugucauuugaacuccugcacgccccagcaacuguuugcggucccaagaaaaguacgaauuuagugaagaacaaaugugucaauuucaacuuuaaugggcugacaggcaccggagugcuaacugagagcaacaagaaguuccucccuuuccagcaguuuggccgggacauugcugauaccacagacgccguacgagauccacagacccuggagauccuugacauaacuccgugcuccuucgggggagugucuguuauuacacccgguacgaauaccucgaaccaagucgcuguguuguaccagggcgugaauuguacugaagucccuguugccauccacgcagaccagcugacaccaaccuggcgcguguauagcacaggguccaacguguuucagacuagagccggaugccucaucggcgcugagcauguaaacaauucauacgaaugugauauucccaucggugcggggauuugcgcaaguuaucaaacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaaaaccuccgucgacuguacgauguauauaugcggagauucaacagaguguaguaaucuguugcuccaguacggcagcuuuugcacccaacugaacagagccuuaacugggaucgcaguggagcaggacaagaauacacaggaaguuuucgcacaggugaaacaaauuuauaagaccccgccuaucaaagauuuuggagguuucaacuuuucgcagauucugccagaccccuccaagccuucuaagaggagcuucaucgaggaucuacucuuuaauaaaguaacucuggcugacgccggcuucauaaagcaguacggggauugucuuggagacaucgcagcccgugauuugauuugcgcucaaaaauucaacggccugaccguccugcccccacucuuaacagacgaaaugaucgcccaguauacgucagcacugcuugcugguaccauuacgaguggguggacauuuggcgccggagcggccuugcagaucccuuucgcuaugcagauggcauaccgguuuaauggcauaggggugacccaaaacgugcucuaugagaaucagaagcugauugccaaccaguucaacuccgcuaucggaaaaauucaggauucucuaagcuccacagccucagcacugggcaagcuccaagacgucguuaaucagaacgcgcaggcccugaauacucuugugaagcaguugagcaguaacuuuggugcuaucucuuccguacugaaugacauauuaagccgacucgauaaaguggaagccgagguccaaaucgacagacugauuaccgggaggcuucagucgcugcagacguacgugacacaacaguugauccgcgcagcugagauucgggccucagcaaaccucgccgcuaccaagaugucugaaugcguucugggacagaguaaaagaguggauuucuguggcaaggguuaccaccuaauguccuuuccccagagcgcgccacauggcgucguguuccugcacguuacuuaugugccggcccaagagaaaaauuuuaccacagcgccugcuaucugccacgacgggaaggcccauuuccccagggaaggagucuuuguaucuaacggcacucacugguucgugacccagcgcaauuuuuacgagccacagauaauuacaacggauaacaccuucguuagcgggaauugugacguggucaucggaaucgugaacaauacuguauaugauccccuccagccugagcuggacuccuucaaagaagaacuugauaaguacuuuaagaaccauacaucaccagacguggauuugggcgacauuagugguaucaaugccagcgucguuaacauucaaaaagaaauagaucgacugaaugagguggcuaagaacuuaaacgaaucucucaucgaccugcaggagcuugggaaauaugagcaguacauuaaguggcccugguauaucuggcugggauucauugcaggccuaaucgccauagugauggucaccaucaugcucugcuguaugacuuccugcuguucaugccugaaagguuguugcaguuguggcagcugcugcaaguuugacgaagaugacuccgagccuguguugaaggggguuaaacugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12978 - RNA, 4039 nt, Artificial Sequence
  SARS-CoV-2/Netherlands/ZuidHolland_2/2020__EPI_ISL_414556 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcacuggagcaggacaaaaauacacaggaaguguucgcgcaaguuaagcagauuuauaaaaccccgccuaucaaggauuuuggagguuucaacuuuucgcagauucuaccagaccccuccaaaccuucuaagaggagcuucaucgaggaucuccuguuuaauaaggugacucuugcugacgccggcuucauaaaacaauacggggauuguuugggagacaucgcagcccgugaucugauuugcgcucagaaguucaacggccucaccguacugcccccauuacugacagacgaaaugaucgcccaguauacgucagcacuuuuggcugguaccauuacgaguggguggacauuuggcgccggagcggcccuccagaucccuuucgcuaugcaaauggcauaccgguuuaauggcauaggggucacccagaacgugcuguaugagaaucagaaacuaauugccaaccaguucaacuccgcuaucggaaagauucaagauucucugagcuccacagccucagcacucggcaaacugcaggacguggucaaucagaacgcgcaggcccuuaauacuuugguuaagcaacugagcaguaacuuuggugcuaucucuuccguguuaaaugacauacucagccgacuggauaagguagaagccgaggugcagaucgacagacuuauuaccgggaggcugcagucguugcaaacguacgucacacagcagcucauccgcgcagcugagauucgggccucagcaaaccuggccgcuaccaaaaugucugaaugcgugcuaggacagaguaagagaguugauuucuguggcaaagguuaccaccugauguccuuuccccaaagcgcgccacauggcguggucuuccuccacgugacuuauguuccggcccaggagaagaauuuuaccacagcuccugcaaucugccacgacgggaaagcccauuuccccagggaaggaguguuugucucuaacggcacucacugguucguaacccagcgcaauuuuuacgagccacagauaauuacaacggauaacaccuucgugagcgggaauugugacguugugaucggaaucgucaacaauacuguguaugauccccugcaaccugagcuugacuccuucaaggaagaguuggauaaauacuuuaagaaccauacaucaccagacguagaucugggcgacauuagugguaucaaugccagcguggucaacauucagaaggaaauagaucgauuaaaugagguugcuaaaaaccucaacgaaucucugaucgaccuucaggagcuggggaaguaugagcaguacauuaaauggcccugguauaucuggcuaggauucauugcaggccucaucgccauagugauggugaccaucaugcugugcuguaugacuuccugcuguucaugcuugaaggguuguugcaguuguggcagcugcugcaaauuugacgaagaugacuccgagccuguccugaagggggugaaguuacacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12979 - RNA, 4039 nt, Artificial Sequence
  SARS-CoV-2/USA/WA-UW31/2020__EPI_ISL_414618 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacggugccgagggcuucaauugcuacuuuccacugcagucuuauggguuccaaccuaccaacggaguuggcuaccagcccuauagggugguagucuugucauuugaacuccugcacgcaccagcuacugugugcggucccaaaaagaguacgaauuuaguuaaaaacaagugugugaauuucaacuuuaaugggcugacaggcaccggaguccuaacugagagcaacaaaaaguuccucccuuuccagcaguuuggccgggacauugccgauaccacagacgcugugcgagauccacaaacccuggagauccuugacauaacuccgugcuccuucgggggaguaucugugauuacacccgguacgaauaccucgaaccagguugccgucuuguaccaggacgugaauuguacugaagugccugucgcaauccacgccgaucagcugacaccaaccuggcgcguuuauagcacaggcuccaacguguuucaaacuagagcugggugccucaucggagcggagcaugugaacaauucauacgaaugugacauucccaucggcgcagguauuugcgccaguuaucagacccagacgaacucuccuaggcgggcucgcagcguagccucccagucaauaaucgcauacaccaugagccugggggccgaaaauucugucgcuuacuccaacaauaguauugccaucccaacaaacuucacuaucagcgugaccacagaaauucuucccguuucuaugacuaagaccuccguggauuguacgauguauauaugcggcgacucaacagaguguaguaaucuguugcuccaauacggcagcuuuugcacccagcugaacagagcauuaacuggaaucgcggucgagcaggauaaaaauacacaggaaguguucgcucaaguuaagcagauuuauaaaaccccgccuaucaaggacuuugggggauucaacuuuucgcagauucugccagaucccuccaaaccuucuaagaggagcuucaucgaggaccuacucuuuaauaaggugacucuggccgaugcagguuucauaaaacaauacggcgacugucuuggggauaucgccgcucgugacuugauuugcgcccagaaguucaacggacugaccguacugcccccacucuuaacagaugaaaugaucgcacaguauacgucagcucugcuugccggcaccauuacgagugguuggacauuuggggcgggcgccgcuuugcagaucccuuucgcaaugcaaauggccuaccgguuuaauggaauaggcgucacccagaacgugcucuaugagaaucagaaacugauugcuaaccaguucaacuccgccaucgggaagauucaagacucucuaagcuccacagcaucagcgcugggaaaacuccaggacguggucaaucagaacgcccaggcucugaauacucuuguuaagcaauugagcaguaacuuuggcgccaucucuuccgugcugaaugauauauuaagccgacucgacaagguagaagcagaggugcagaucgauagacugauuaccgguaggcuucagucgcugcaaacguacgucacacagcaguugauccgcgcugccgagauucgggcaucagccaaccucgcugcgaccaaaaugucugaaugcgugcuggggcagaguaagagaguugacuucuguggaaaaggcuaccaccuaauguccuuuccccaaagcgccccacaugguguggucuuccugcacgugacuuauguuccggcacaggagaagaauuuuaccacagcuccugccaucugccacgauggcaaagcccauuuccccagggaagggguguuugucucuaacggaacucacugguucguaacccagcgcaauuuuuacgagccacagauaauuacaacggacaacaccuucgugagcggcaauugugauguugugaucgggaucgucaacaauacuguguaugacccccuccaaccugagcuggauuccuucaaggaggaacuugacaaauacuuuaagaaccauacaucaccagauguagacuugggagauauuaguggcaucaaugcuagcguggucaacauucagaaggaaauagaccgacugaaugagguugccaaaaacuuaaacgaaucucucaucgaccugcaggagcuugguaaguaugagcaguacauuaaauggcccugguauaucuggcugggguucauugcaggacuaaucgcgauagugauggugaccaucaugcucugcuguaugacuuccugcuguucaugccugaagggcuguugcaguugugguagcugcugcaaauuugaugaagacgauuccgagccugucuugaagggcgugaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12980 - RNA, 4039 nt, Artificial Sequence
  SARS-CoV-2/South Korea/SNU01/2020__EPI_ISL_411929 spike protein mRNA human (1-1273)
aggagaaagcuuaccauguucguguuucugguccuccuuccccugguuagcucccagugcgugaacuugaccacaagaacucaauuaccuccagccuacaccaauucuuucacgaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuugggcucuugagccuuugguggaucugccaaucggcauuaacaucacacgguuccagacucuacucgcccugcaucgcagcuaucuuaccccgggcgacucuuccucaggguggacagcaggagccgcugcauacuauguagguuaccugcaacccagaaccuuuuugcucaaauauaaugaaaacggcacgauuacugaugccguggacugcgcucuggauccuuuaagcgagacaaaguguacccugaagaguuucacugucgaaaaagggaucuaccagacaucuaauuuuagggugcagccaaccgaguccauaguucgguuccccaacauuacgaaucucugcccuuuuggagagguguucaacgccacccgcuucgcgagcgucuaugcauggaaucgaaagagaaucucgaacuguguggccgacuacucuguacuuuacaauuccgcuucauuuaguacauucaaaugcuauggcguuagcccaacuaagcugaacgacuuguguuuuaccaauguguacgccgauuccuucgucauuaggggugacgaagugcggcagaucgcacccgggcaaacaggaaaaaucgcugauuauaacuacaagcuaccggacgauuuuacuggcugcgucauugccuggaacucuaauaaccuggacagcaaagugggcgggaauuauaacuaccucuaucgucuguuccgcaagucaaaucuuaagccuuuugagagagauauaaguaccgaaaucuaccaggcgggauccacacccuguaacgguguugagggcuucaauugcuacuuuccacugcagagcuauggguuccaaccuaccaacggagugggcuaccagcccuauaggguagucguguugucuuuugaacuccugcacgccccagcaacuguuugcggucccaaaaagucaacgaauuuagugaaaaacaagugugucaauuucaacuuuaaugggcugacaggcaccggagugcuaacugagaguaacaaaaaguuccucccuuuccagcaguuuggccgggacauugcugauaccacagacgccguacgagauccacaaacccuggagauccuugacauaacuccgugcagcuucgggggaguguccguuauuacacccgguacgaauaccucuaaccaggucgcuguguuguaccaggacgugaauuguacugaagucccuguugccauccacgcagaucagcugacaccaaccuggcgcguguauucgacaggcagcaacguguuucaaacuagagccgggugccucaucggagcugagcauguaaacaauuccuacgaaugugacauucccaucggcgcggguauuugcgcaucauaucagacccagacgaacaguccuaggcgggcccgcucugucgcuagccaguccauaaucgccuacaccaugucacugggggcagagaauagcguggccuacucuaacaauuccauugcuaucccaacaaacuucacuaucaguguuaccacagaaauucuucccgugagcaugacuaagaccucugucgauuguacgauguauauaugcggcgacuccacagaguguucaaaucuguugcuccaauacggaaguuuuugcacccagcugaacagagccuuaacuggcaucgcaguggagcaggauaaaaauacacaggaaguuuucgcgcaagugaagcagauuuauaaaaccccgccuaucaaggacuuugggggauucaacuuuagccagauucugccagaucccucgaaaccuuccaagaggucuuucaucgaggaccuacucuuuaauaagguaacucuggcugaugccgguuucauaaaacaauacggcgacugucuuggggauaucgcagcccgugacuugauuugcgcucagaaguucaacggacugaccguccucccuccacuguuaacagaugaaaugaucgcccaguauacgagcgcacugcuugcuggcaccauuacuucagguuggacauuuggggccggcgcggccuugcagaucccuuucgcuaugcaaauggcauaccgguuuaauggaauaggcgugacccagaacgugcucuaugagaaucagaaacugauugccaaccaguucaacagugcuaucgggaagauucaagacucccuaucuagcacagccuccgcacugggaaaacuccaggacgucguuaaucagaacgcgcaggcccugaauacucuugugaagcaauugucaagcaacuuuggcgcuaucaguucuguacugaaugauauauuaucccgacucgacaagguggaagccgagguccagaucgauagacugauuaccgguaggcuucagagccugcaaacguacgugacacagcaguugauccgcgcagcugagauucgggccucggcaaaccucgccgcuaccaaaaugucagaaugcguucuggggcagucuaagagaguggacuucuguggaaaaggcuaccaccuaaugaguuuuccccaauccgcgccacauggugucguguuccugcacguuacuuaugugccggcccaggagaagaauuuuaccacagcacccgcuaucugccacgauggcaaagcccauuuccccagggaaggggucuuuguaagcaacggaacucacugguucgugacccagcgcaauuuuuacgagccacagauaauuacaacggacaacaccuucguuucuggcaauugugauguggucaucgggaucgugaacaauacuguauaugacccccuccaaccugagcuggauagcuucaaggaagaacuugacaaauacuuuaagaaccauacauccccagauguggacuugggagauauuucaggcaucaaugccagugucguuaacauucagaaggaaauagaccgacugaaugagguggcuaaaaacuuaaacgaaagccucaucgaccugcaggagcuugguaaguaugagcaguacauuaaauggcccugguauaucuggcugggguucauugcaggacuaaucgccauagugauggucaccaucaugcucugcuguaugacuucuugcuguuccugccugaagggcuguugcucaugugguaguugcugcaaauuugaugaagacgauagcgagccuguguugaagggcguuaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12981 - RNA, 4039 nt, Artificial Sequence
  SARS-CoV-2/China/WF0004/2020__EPI_ISL_413694 spike protein mRNA human (1-1273)
aggagaaagcuuaccauguucguguuucugguccuccuuccccugguuagcucccagugcgugaacuugaccacaagaacucaauuaccuccagccuacacgaauagcuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggacugagucugaguuccguguguacagcuccgcgaauaacuguaccuuugaguaugugucacaaccuuuccugauggaccuggaaggcaagcaggguaauuuuaaaaaccucagagaguucgucuuuaagaacauugauggguacuucaaaaucuacaguaagcacacaccaauaaauuuaguuagggaccugccccagggauuuagcgcucuugagccuuugguggaucugccaaucggcauuaacaucacucgguuccagacccuacucgcccugcaucgcucuuaucuuacaccgggcgacuccucaagcggguggaccgcaggagccgcugcauacuauguagguuaccugcaacccagaacguuuuugcucaaauauaaugaaaacggcacuauuacagaugccguggacugcgcucuggauccuuuaagugagaccaaguguacucugaagucuuucacagucgaaaaagggaucuaccagaccuccaauuuuagggugcagccaacggagagcauaguucgguuccccaacauuaccaaucucugcccuuuuggagagguguucaacgccacacgcuucgcgucggucuaugcauggaaucgaaagagaaucucuaacuguguggccgacuacuccguacuuuacaauucagcuaguuuuagcacuuucaaaugcuauggcguuuccccaaccaagcugaacgacuuguguuuuacaaauguguacgccgauucuuucgucauuaggggugacgaagugcggcagaucgcacccgggcaaacuggaaaaaucgcugauuauaacuacaagcuaccggacgauuuuaccggcugcgucauugccuggaauagcaacaaccuggacucaaaagugggcgggaauuauaacuaccucuaucgucuguuccgcaagaguaaucuuaagccuuuugagagagauauauccacagaaaucuaccaggcgggaagcacccccuguaacgguguugagggcuucaauugcuacuuuccacugcagucuuauggguuccaaccuacuaacggagugggcuaccagcccuauaggguagucguguugucauuugaacuccugcacgccccagcaacgguuugcggucccaaaaagaguacaaauuuagugaaaaacaagugugucaauuucaacuuuaaugggcugaccggcacuggagugcuaaccgagagcaacaaaaaguuccucccuuuccagcaguuuggccgggacauugcugauacaaccgacgccguacgagauccacaaacucuggagauccuugacauaacaccgugcuccuucgggggagugucuguuauuacgcccgguaccaauacuucgaaccaggucgcuguguuguaccaggacgugaauuguacagaagucccuguugccauccacgcagaucagcugaccccaacauggcgcguguauagcacuggcuccaacguguuucaaaccagagccgggugccucaucggagcugagcauguaaacaauucauacgaaugugacauucccaucggcgcggguauuugcgcaaguuaucagacgcagaccaacucuccuaggcgggcccgcagcgucgcuucccagucaauaaucgccuacacaaugagccugggggcagaaaauucuguggccuacuccaacaauaguauugcuaucccaacuaacuucaccaucagcguuacaacugaaauucuucccgugucuaugaccaagacguccgucgauuguacaauguauauaugcggcgacucaaccgaguguaguaaucuguugcuccaauacggaucuuuuugcacucagcugaacagagccuuaacaggcaucgcaguggagcaggauaaaaauacccaggaaguuuucgcgcaagugaagcagauuuauaaaacuccgccuaucaaggacuuugggggauucaacuuuucgcagauucugccagaucccuccaaaccuucuaagaggagcuucaucgaggaccuacucuuuaauaagguaacccuggcugaugccgguuucauaaaacaauacggcgacugucuuggggauaucgcagcccgugacuugauuugcgcucagaaguucaacggacugacaguccugcccccacucuuaacggaugaaaugaucgcccaguauaccucagcacugcuugcuggcacuauuacaagugguuggaccuuuggggccggcgcggccuugcagaucccuuucgcuaugcaaauggcauaccgguuuaauggaauaggcgugacacagaacgugcucuaugagaaucagaaacugauugccaaccaguucaacuccgcuaucgggaagauucaagacucucuaagcuccacugccucagcacugggaaaacuccaggacgucguuaaucagaacgcgcaggcccugaauacccuugugaagcaauugagcaguaacuuuggcgcuaucucuuccguacugaaugauauauuaagccgacucgacaagguggaagccgagguccagaucgauagacugauuacggguaggcuucagucgcugcaaacauacgugacccagcaguugauccgcgcagcugagauucgggccucagcaaaccucgccgcuacuaaaaugucugaaugcguucuggggcagaguaagagauucgacuuuuguggaaaaggcuaccaccuaauguccuucccccaaagcgcgccacaugguguggucuuucugcacgugaccuauguuccggcccaggagaagaauuucacaacugcuccugcaaucugccacgauggcaaagcccauuuucccagggaagggguguucgucucuaacggaacccacugguuuguaacacagcgcaauuucuacgagccacagauaauuacgaccgacaacacuuucgugagcggcaauugugauguugugaucgggaucgucaacaauacaguguaugacccccuccaaccugagcuggauuccuuuaaggaagaacuugacaaauacuucaagaaccauaccucaccagauguagacuugggagauauuaguggcaucaaugccagcguggucaacauucagaaggaaauagaccgacugaaugagguugcuaaaaacuuaaacgaaucucucaucgaccugcaggagcuugguaaguaugagcaguacauuaaauggcccugguauaucuggcugggguuuauugcaggacuaaucgccauagugauggugacuaucaugcucugcuguaugacauccugcuguucaugccugaagggcuguugcaguugugguagcugcugcaaauucgaugaagacgauuccgagccugucuugaagggcgugaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12982 - RNA, 4039 nt, Artificial Sequence
  SARS-CoV-2/China/WF0028/2020__EPI_ISL_413791 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacaggaaguuuucgcgcaagugaagcagauuuauaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauacggcgacugucuuggggauaucgcagcccgugacuugauuugcgcucagaaguucaacggacugaccguccugcccccacucuuaacagaugaaaugaucgcccaguauacgucagcacugcuugcuggcaccauuacgagugguuggacauuuggggccggcgcggccuugcagaucccuuucgcuaugcaaauggcauaccgguuuaauggaauaggcgugacccagaacgugcucuaugagaaucagaaacugauugccaaccaguucaacuccgcuaucgggaagauucaagacucucuaagcuccacagccucagcacugggaaaacuccaggacgucguuaaucagaacgcgcaggcccugaauacucuugugaagcaauugagcaguaacuuuggcgcuaucucuuccguacugaaugauauauuaagccgacucgacaagguggaagccgagguccagaucgauagacugauuaccgguaggcuucagucgcugcaaacguacgugacacagcaguugauccgcgcagcugagauucgggccucagcaaaccucgccgcuaccaaaaugucugaaugcguucuggggcagaguaagagaguggacuucuguggaaaaggcuaccaccuaauguccuuuccccaaagcgcgccacauggugucguguuccugcacguuacuuaugugccggcccaggagaagaauuuuaccacagcuccugcaaucugccacgauggcaaagcccauuuccccagggaaggggucuuuguaucuaacggaacucacugguucgugacccagcgcaauuuuuacgagccacagauaauuacaacggacaacaccuucguuagcggcaauugugauguggucaucgggaucgugaacaauacuguauaugacccccuccaaccugagcuggaauccuucaaggaggaacuugauaaauacuuuaagaaccauacaucaccagacguggauuugggagacauuaguggcaucaaugccagcgucguuaacauucagaaggagauagaucgacugaaugaaguggcuaaaaacuuaaacgagucucucaucgaccugcaggagcuugguaaguaugaacaguacauuaaauggcccugguauaucuggcugggguucauugcaggacuaaucgccauagugauggucaccaucaugcucugcuguaugacuuccugcuguucaugccugaagggcuguugcaguugugguagcugcugcaaauuugacgaggaugacuccgaaccuguguugaagggcguuaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12983 - RNA, 4039 nt, Artificial Sequence
  SARS-CoV-2/2019-nCoV/USA-CruiseA-18/2020__MT159716.1 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaacugcguguguacagcuccgcgaauaacuguacuuucgaguaugugucacaaccuuuucugauggaccucgaaggcaagcaggguaauuucaaaaacuuaagagaguuugucuucaagaacauugauggguacuuuaaaaucuacaguaagcacaccccaauaaaucugguuagggaccuuccccagggauucagcgcuuuggagccucugguggaucuaccaaucggcauuaacaucacacgguuucagacucuccuggcccuucaucgcucuuaucugaccccgggcgacuccucaagcggguggacagcaggagccgcugcauacuauguagguuacuugcaacccagaaccuuccuccugaaauauaaugaaaacggcacgauuacugaugccguggacugcgcuuuagauccucugagugagacaaaguguacccucaagucuuuuacugucgaaaaagggaucuaccagacauccaauuucagggugcagccaaccgagagcauaguucgguuucccaacauuacgaaucuuugcccuuucggagagguguuuaacgccacccgcuucgcgucggucuaugcauggaaucgaaagagaaucucuaacuguguggccgacuacuccguacuguacaauucagcuaguuucagcacauuuaaaugcuauggcguuuccccaacuaaguugaacgaccuauguuucaccaauguguacgccgauucuuuugucauuaggggugacgaagugcggcagaucgcacccgggcaaacaggaaaaaucgcugauuauaacuacaagcugccggacgauuucacuggcugcgucauugccuggaauagcaacaaccucgacucaaaagugggcgggaauuauaacuaccuguaucgucuuuuucgcaagaguaaucugaagccuuucgagagagauauauccaccgaaaucuaccaggcgggaagcacacccuguaacgguguugagggcuuuaauugcuacuucccauugcagucuuauggguuucaaccuaccaacggagugggcuaccagcccuauaggguagucgugcucucauucgaacuguuacacgccccagcaacuguuugcggucccaaaaagaguacgaaucuggugaaaaacaagugugucaauuuuaacuucaaugggcuaacaggcaccggagugcucacugagagcaacaaaaaguuucugccuuuccagcaguucggccgggacauugcugauaccacagacgccguacgagauccacaaacccuugagaucuuggacauaacuccgugcuccuuugggggagugucuguuauuacacccgguacgaauaccucgaaccaggucgcugugcuguaccaggacgugaauuguacugaagucccuguugccauccacgcagaucagcucacaccaaccuggcgcguguauagcacaggcuccaacguguuccaaacuagagccgggugccugaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccuuggggcagaaaauucuguggccuacuccaacaauaguauugcuaucccaacaaacuuuacuaucagcguuaccacagaaauucugcccgugucuaugacuaagaccuccgucgauuguacgauguauauaugcggcgacucaacagaguguaguaauuugcuccugcaauacggcagcuucugcacccaguuaaacagagcccugacuggaaucgcaguggagcaggauaaaaauacacaggaaguuuuugcgcaagugaagcagauuuauaaaaccccgccuaucaaggacuucgggggauuuaacuucucgcagauucuaccagaucccuccaaaccuucuaagaggagcuuuaucgaggaccuccuguucaauaagguaacucuugcugaugccgguuuuauaaaacaauacggcgacuguuugggggauaucgcagcccgugaccugauuugcgcucagaaguucaacggacucaccguccugcccccauuacugacagaugaaaugaucgcccaguauacgucagcacuuuuggcuggcaccauuacgagugguuggacauucggggccggcgcggcccuccagaucccuuuugcuaugcaaauggcauaccgguucaauggaauaggcgugacccagaacgugcuguaugagaaucagaaacuaauugccaaccaguuuaacuccgcuaucgggaagauucaagacucucugagcuccacagccucagcacucggaaaacugcaggacgucguuaaucagaacgcgcaggcccuuaauacuuuggugaagcaacugagcaguaacuucggcgcuaucucuuccguauuaaaugauauacucagccgacuggacaagguggaagccgagguccagaucgauagacuuauuaccgguaggcugcagucguugcaaacguacgugacacagcagcucauccgcgcagcugagauucgggccucagcaaaccuggccgcuaccaaaaugucugaaugcguucuagggcagaguaagagaguggacuuuuguggaaaaggcuaccaccugauguccuucccccaaagcgcgccacauggugucguguuucuccacguuacuuaugugccggcccaggagaagaauuucaccacagcuccugcaaucugccacgauggcaaagcccauuuucccagggaaggggucuucguaucuaacggaacucacugguuugugacccagcgcaauuucuacgagccacagauaauuacaacggacaacaccuuuguuagcggcaauugugauguggucaucgggaucgugaacaauacuguauaugacccccugcaaccugagcuugauuccuucaaggaagaguuggacaaauacuucaagaaccauacaucaccagauguggaccugggagauauuaguggcaucaaugccagcgucguuaacauucagaaggaaauagaccgauuaaaugagguggcuaaaaaccucaacgaaucucugaucgaccuucaggagcuggguaaguaugagcaguacauuaaauggcccugguauaucuggcuaggguuuauugcaggacucaucgccauagugauggucaccaucaugcugugcuguaugacuuccugcuguucaugcuugaagggcuguugcaguugugguagcugcugcaaauucgaugaagacgauuccgagccugugcugaagggcguuaaguuacacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12984 - RNA, 4039 nt, Artificial Sequence
  SARS-CoV-2/SARS-CoV-2/Yunnan-01/human/2020/CHN__MT049951.1 spike protein mRNA human (1-1273)
aggagaaagcuuaccauguucguguuucugguccuccuuccccugguuagcucccagugcgugaacuugaccacaagaacucaauuaccuccagccaauacgaacucuuucaccaggggcguauacuauccggacaagguguuucggucaaguguccugcacagcacacaggaucuauuccuccccuuuuucuccaaugugacuugguuucaugcuauccacguuucugggaccaacggaacaaaacgcuucgacaauccugugcugccauuuaacgauggugucuacuucgcaucgaccgagaagucaaauauuauacgaggcuggaucuuugggacuacacuugacagcaaaacccagagucuguugauugugaacaaugccacgaacguaguuaucaaggugugugaguuccaguuuugcaaugaucccuuccucggagucuauuaccauaaaaacaauaaguccuggauggagucugaguuccguguguauagcuccgcgaacaauuguacuuuugaauacgugucacaaccuuuccugauggaccuggaaggcaagcaggguaacuuuaaaaaccucagagaguucgucuuuaagaauauugauggguauuucaaaaucuacaguaagcacaccccaauaaacuuaguuagggaccugccccagggauuuagcgcucuugagccuuugguggaucugccaaucggcauuaauaucacacgguuccagacucuacucgcccugcaucgcucuuaccuuaccccgggcgacuccucaagcggguggacagcaggagccgcugcauauuacguagguuaucugcaacccagaaccuuuuugcucaaauacaacgaaaauggcacgauuacugaugccguggacugcgcucuggauccuuuaagugagacaaaguguacccugaagucuuucacugucgaaaaagggaucuaucagacauccaacuuuagggugcagccaaccgagagcauaguucgguuccccaauauuacgaaccucugcccuuuuggagagguguucaaugccacccgcuucgcgucggucuacgcauggaaccgaaagagaaucucuaauuguguggccgacuauuccguacuuuacaacucagcuaguuuuagcacauucaaaugcuacggcguuuccccaacuaagcugaaugacuuguguuuuaccaacguguaugccgauucuuucgucauuaggggugacgaagugcggcagaucgcacccgggcaaacaggaaaaaucgcugauuacaauuauaagcuaccggacgauuuuacuggcugcgucauugccuggaacagcaacaaucuggacucaaaagugggcgggaacuacaauuaucucuaccgucuguuccgcaagaguaaccuuaagccuuuugagagagauauauccaccgaaaucuaucaggcgggaagcacacccuguaaugguguugagggcuucaacugcuacuuuccacugcagucuuacggguuccaaccuaccaauggagugggcuaucagcccuacaggguagucguguugucauuugaacuccugcacgccccagcaacuguuugcggucccaaaaagaguacgaacuuagugaaaaauaagugugucaacuucaauuuuaacgggcugacaggcaccggagugcuaacugagagcaauaaaaaguuccucccuuuccagcaguuuggccgggacauugcugauaccacagacgccguacgagauccacaaacccuggagauccuugacauaacuccgugcuccuucgggggagugucuguuauuacacccgguacgaacaccucgaaucaggucgcuguguuguaucaggacgugaacuguacugaagucccuguugccauccacgcagaucagcugacaccaaccuggcgcguguacagcacaggcuccaacguguuucaaacuagagccgggugccucaucggagcugagcauguaaauaacucauaugaaugugacauucccaucggcgcggguauuugcgcaaguuaccagacccagacuaauucuccuaggcgggcccgcagcgucgcuucccagucaauaaucgccuauaccaugagccugggggcagagaacucuguggccuacuccaauaacaguauugcuaucccaacaaauuucacuaucagcguuaccacagaaauucuucccgugucuaugacuaagaccuccgucgauuguacgauguacauaugcggcgacucaacagaguguaguaaccuguugcuccaauauggcagcuuuugcacccagcugaauagagccuuaacuggaaucgcaguggagcaggauaaaaacacacaggaaguuuucgcgcaagugaagcagauuuacaaaaccccgccuaucaaggacuuugggggauucaauuuuucgcagauucugccagaucccuccaaaccuucuaagaggagcuucaucgaggaccuacucuuuaacaagguaacucuggcugaugccgguuucauaaaacaauauggcgacugucuuggggauaucgcagcccgugacuugauuugcgcucagaaguucaauggacugaccguccugcccccacucuuaacagaugaaaugaucgcccaguacacgucagcacugcuugcuggcaccauuacgagugguuggacauuuggggccggcgcggccuugcagaucccuuucgcuaugcaaauggcauaucgguuuaacggaauaggcgugacccagaaugugcucuacgagaaccagaaacugauugccaaccaguucaauuccgcuaucgggaagauucaagacucucuaagcuccacagccucagcacugggaaaacuccaggacgucguuaaccagaaugcgcaggcccugaacacucuugugaagcaauugagcaguaauuuuggcgcuaucucuuccguacugaacgauauauuaagccgacucgacaagguggaagccgagguccagaucgauagacugauuaccgguaggcuucagucgcugcaaacguaugugacacagcaguugauccgcgcagcugagauucgggccucagcaaaucucgccgcuaccaaaaugucugaaugcguucuggggcagaguaagagaguggacuucuguggaaaaggcuaccaccuaauguccuuuccccaaagcgcgccacauggugucguguuccugcacguuacuuacgugccggcccaggagaagaacuuuaccacagcuccugcaaucugccacgauggcaaagcccauuuccccagggaaggggucuuuguaucuaauggaacucacugguucgugacccagcgcaacuuuuaugagccacagauaauuacaacggacaauaccuucguuagcggcaacugugauguggucaucgggaucgugaauaacacuguauacgacccccuccaaccugagcuggauuccuucaaggaagaacuugacaaauauuuuaagaaucauacaucaccagauguggacuugggagauauuaguggcaucaacgccagcgucguuaauauucagaaggaaauagaccgacugaacgagguggcuaaaaacuuaaaugaaucucucaucgaccugcaggagcuugguaaguacgagcaguauauuaaauggcccugguacaucuggcugggguucauugcaggacuaaucgccauagugauggucaccaucaugcucugcuguaugacuuccugcuguucaugccugaagggcuguugcaguugugguagcugcugcaaauuugaugaagacgauuccgagccuguguugaagggcguuaagcugcacuauacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12985 - RNA, 4039 nt, Artificial Sequence
  SARS-CoV-2/USA/WA-UW292/2020__EPI_ISL_418077 spike protein mRNA human (1-1273)
aggagaaagcuuaccauguucguguuucugguccuccuuccccugguuagcucccagugcgugaacuugaccacaagaacucaauuaccuccagccuacaccaauucuuucacgaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgagcucuacacccuguaacggaguugaggguuucaauugcuacuuuccacugcagucauauggcuuccaaccuaccaacggggugggauaccagcccuauaggguagucguguugaguuuugaacuccugcacgccccagcaacuguuugcggccccaaaaagagcacgaauuuagugaaaaacaagugugucaauuucaacuuuaauggucugacagggaccggcgugcuaacugaguccaacaaaaaguuccucccuuuccagcaguuuggacgggacauugcugauaccacagacgccguacgagauccacaaacccuggagauccuugacauaacuccgugcucuuucggcggggugucgguuauuacacccggaacgaauaccagcaaccaggucgcuguguuguaccaggacgugaauuguacugaagucccuguugccauccacgcagaucagcugacaccaaccuggcgcguguauuccacagguucaaacguguuucaaacuagagccggcugccucaucggggcugagcauguaaacaauaguuacgaaugugacauucccaucggagcgggcauuugcgcaucuuaucagacccagacgaacagcccuaggcgggcccgcuccgucgcuucacagagcauaaucgccuacaccaugucucugggugcagaaaauuccguggccuacaguaacaauagcauugcuaucccaacaaacuucacuaucucuguuaccacagaaauucuucccguguccaugacuaagaccucagucgauuguacgauguauauaugcggggacaguacagaguguagcaaucuguugcuccaauacggcucguuuugcacccagcugaacagagccuuaacuggaaucgcaguggagcaggauaaaaauacacaggaaguuuucgcgcaagugaagcagauuuauaaaaccccgccuaucaaggacuuuggcggguucaacuuuucccagauucugccagaucccucuaaaccuagcaagaggucauucaucgaggaccuacucuuuaauaagguaacucuggcugaugccggauucauaaaacaauacggugacugucuuggcgauaucgcagcccgugacuugauuugcgcucagaaguucaacgggcugaccguccucccuccacuguuaacagaugaaaugaucgcccaguauacgagugcacugcuugcuggaaccauuacuuccggcuggacauuuggugccggggcggccuugcagaucccuuucgcuaugcaaauggcauaccgguuuaauggcauaggagugacccagaacgugcucuaugagaaucagaaacugauugccaaccaguucaacucugcuaucggcaagauucaagacagccuauccucaacagccagcgcacuggggaaacuccaggacgucguuaaucagaacgcgcaggcccugaauacucuugugaagcaauugaguucuaacuuuggagcuaucuccagcguacugaaugauauauuaucgcgacucgacaagguggaagccgagguccagaucgauagacugauuaccggcaggcuucagucacugcaaacguacgugacacagcaguugauccgcgcagcugagauucgggccucugcaaaccucgccgcuaccaaaaugagugaaugcguucugggucaguccaagagaguggacuucugugggaaaggauaccaccuaaugagcuuuccccaaucugcgccacauggcgucguguuccugcacguuacuuaugugccggcccaggagaagaauuuuaccacagcacccgcuaucugccacgaugguaaagcccauuuccccagggaaggcgucuuuguaagcaacgggacucacugguucgugacccagcgcaauuuuuacgagccacagauaauuacaacggacaacaccuucguuuccggaaauugugauguggucaucggcaucgugaacaauacuguauaugacccccuccaaccugagcuggauucauucaaggaagaacuugacaaauacuuuaagaaccauacaaguccagauguggacuugggggauauuagcggaaucaaugccucugucguuaacauucagaaggaaauagaccgacugaaugagguggcuaaaaacuuaaacgaaucccucaucgaccugcaggagcuuggcaaguaugagcaguacauuaaauggcccugguauaucuggcuggguuucauugcagggcuaaucgccauagugauggucaccaucaugcucugcuguaugacuucaugcuguaguugccugaagggauguugcagcuguggcuccugcugcaaauuugaugaagacgauucugagccuguguugaaggguguuaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12986 - RNA, 4039 nt, Artificial Sequence
  SARS-CoV-2/Iceland/192/2020__EPI_ISL_417819 spike protein mRNA human (1-1273)
aggagaaagcuuaccauguucguguuuuucguccugcucccccuuguuagcucccagugcgugaaccugaccacaagaacucaauugccuccagccuacacuaauucuuuuaccaggggcguauauuacccggacaagguguuccggucaagugucuuacacagcacacaggaucuguuucuacccuucuuuuccaacgugacuugguuccaugcuauccacguuucugggaccaauggaacaaaacgcuuugacaacccugugcucccauucaaugauggugucuauuuugcaucgaccgagaagucaaacauuauacgaggcuggaucuucgggacuacacuggacagcaaaacccagagucuucugauugugaauaacgccacgaauguaguuaucaaggugugugaauuucaguucugcaacgaucccuucuugggagucuacuaucauaaaaauaacaaguccuggauggagucugaauuucguguguacagcuccgcgaauaacuguacuuucgaguaugugucacaaccuuuucucauggaccuggaaggcaagcaggguaauuucaaaaaccugagagaguuugucuucaagaacauugauggguacuuuaaaaucuacaguaagcacaccccaauaaaucucguuagggacuuaccccagggauucagcgcucuggagccucuuguggauuugccaaucggcauuaacaucacacgguuucagacucugcuagcccuccaucgcucuuaucugaccccgggcgacuccucaagcggguggacagcaggagccgcugcauacuauguagguuaccuucaacccagaaccuuccuguugaaauauaaugaaaacggcacgauuacugaugccguggacugcgcucucgauccucugagugagacaaaguguaccuuaaagucuuuuacugucgaaaaagggaucuaccagacauccaauuucagggugcagccaaccgagagcauaguucgguuucccaacauuacgaaucugugcccuuucggagagguguucaacgccacccgcuuugcgucggucuaugcauggaaucgaaagagaaucucuaacuguguggccgacuacuccguacucuacaauucagcuaguuucagcacauuuaaaugcuauggcguuuccccaacuaaacuuaacgaccuguguuucaccaauguguacgccgauucuuuugucauuaggggugacgaagugcggcagaucgcacccgggcaaacaggaaagaucgcugauuauaacuacaaguugccggacgauuucacuggcugcgucauugccuggaauagcaacaaccuagacucaaaagugggcgggaauuauaacuaccuguaucgucucuuucgcaagaguaaucugaagccuuucgagagagauauauccaccgaaaucuaccaggcgggaagcacacccuguaacgguguugagggcuuuaauugcuacuucccacuucagucuuauggguuucaaccuaccaacggagugggcuaccagcccuauaggguagucgugcugucauucgaauugcuccacgccccagcaacuguuugcggucccaaaaagaguacgaaucuggugaaaaacaagugugucaauuuuaacuucaauggguuaacaggcaccggagugcugacugagagcaacaaaaaguuccuaccuuuucagcaguucggccgggacauugcugauaccacagacgccguacgagauccacaaacccucgagauccuggacauaacuccgugcuccuuugggggagugucuguuauuacacccgguacgaauaccucgaaccaggucgcugugcuuuaccagggcgugaauuguacugaagucccuguugccauccacgcagaccaguugacaccaaccuggcgcguguauagcacaggguccaacguguuccaaacuagagccggaugccugaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccucggcgcagaaaauucuguggccuacuccaacaauaguauugcuaucccaacaaacuuuacuaucagcguuaccacagaaauucugcccgugucuaugacuaagaccuccgucgacuguacgauguauauaugcggagauucaacagaguguaguaaucuucuguugcaauacggcagcuucugcacccagcucaacagagcccugacugggaucgcaguggagcaggacaaaaauacacaggaaguuuuugcgcaagugaagcagauuuauaaaaccccgccuaucaaggauuucggagguuuuaacuucucgcagauuuuaccagaccccuccaaaccuucuaagaggagcuuuaucgaggaucugcuauucaauaagguaacucucgcugacgccggcuucauaaaacaauacggggauugucugggagacaucgcagcccgugaucuuauuugcgcucagaaguuuaacggcuugaccguccugcccccacuccugacagacgaaaugaucgcccaguauacgucagcauuacuggcugguaccauuacgaguggguggacauucggcgccggagcggcccuucagaucccuuuugcuaugcaaauggcauaccgguucaauggcauaggggugacccagaacguguuguaugagaaucagaaacucauugccaaccaguuuaacuccgcuaucggaaagauucaagauucucugagcuccacagccucagcacuaggcaaacugcaggacgucguuaaucagaacgcgcaggcccucaauacucuggugaagcaacuuagcaguaacuucggugcuaucucuuccguauugaaugacauacugagccgauuagauaagguggaagccgagguccagaucgacagacucauuaccgggaggcugcagucgcuucaaacguacgugacacagcagcugauccgcgcagcugagauucgggccucagcaaacuuggccgcuaccaaaaugucugaaugcguucucggacagaguaagagaguggauuuuuguggcaaagguuaccaccugauguccuucccccaaagcgcgccacauggcgucguguuucuacacguuacuuaugugccggcccaggagaagaauuucaccacagcuccugcaaucugccacgacgggaaagcccauuuucccagggaaggagucuucguaucuaacggcacucacugguuugugacccagcgcaauuucuacgagccacagauaauuacaacggauaacaccuucguuagcgggaauugugacguggucaucggaaucgugaacaauacuguauaugauccccugcaaccugagcucgacuccuuuaaggaggagcuggauaaauacuucaagaaccauacaucaccagacguggaucuuggcgacauuagugguaucaaugccagcgucguuaacauucagaaggaaauagaucgauugaaugagguggcuaaaaaccugaacgaaucuuuaaucgaccuccaggagcuggggaaguaugagcaguacauuaaauggcccugguauaucuggcuuggauuuauugcaggccugaucgccauagugauggucaccaucaugcuaugcuguaugacuuccugcuguucaugccucaaggguuguugcaguuguggcagcugcugcaaauucgacgaagaugacuccgagccugugcugaaggggguuaaguugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12987 - RNA, 4039 nt, Artificial Sequence
  SARS-CoV-2/Belgium/ULG-6939/2020__EPI_ISL_417020 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucugugguuuacuccaacaauaguauugccaucccaacaaacuucacuaucagcgugaccacagaaauucuucccgucucuaugacuaagaccuccguggacuguacgauguauauaugcggagauucaacagaguguaguaaucuguugcuccaauacggcagcuuuugcacccagcugaacagagcuuuaacugggaucgccguugagcaggacaaaaauacacaggaaguguucgcacaaguaaagcagauuuauaaaaccccgccuaucaaggauuuuggagguuucaacuuuucgcagauucugccagaccccuccaaaccuucuaagaggagcuucaucgaggaucuacucuuuaauaaggucacucuggcggacgcuggcuucauaaaacaauacggggauugucuuggagacaucgccgcacgugauuugauuugcgcccagaaguucaacggccugaccgugcugcccccacucuuaacagacgaaaugaucgcucaguauacgucagcccugcuugcagguaccauuacgaguggguggacauuuggcgcuggagccgcguugcagaucccuuucgccaugcaaauggcuuaccgguuuaauggcauaggggugacccagaacguccucuaugagaaucagaaacugauugcaaaccaguucaacuccgccaucggaaagauucaagauucucuaagcuccacagcuucagcccugggcaaacuccaggacguugugaaucagaacgcacaggcgcugaauacucuuguaaagcaauugagcaguaacuuuggugccaucucuuccgugcugaaugacauauuaagccgacucgauaaggucgaagcugaggugcagaucgacagacugauuaccgggaggcuucagucgcugcaaacguacguuacacagcaguugauccgcgccgcagagauucgggcuucagccaaccucgcagccaccaaaaugucugaaugcgugcugggacagaguaagagagucgauuucuguggcaaagguuaccaccuaauguccuuuccccaaagcgcuccacauggcgugguuuuccugcacgugacuuaugucccggcgcaggagaagaauuuuaccacagccccugcaaucugccacgacgggaaagcucauuuccccagggaaggaguauuugugucuaacggcacucacugguucguuacccagcgcaauuuuuacgagccacagauaauuacaacggauaacaccuucgugagcgggaauugugacgucgugaucggaaucguaaacaauacuguguaugauccccuccaaccugagcuggacuccuucaaggaagaacuugauaaauacuuuaagaaccauacaucaccagacgucgauuugggcgacauuagugguaucaaugccagcguugugaacauucagaaggaaauagaucgacugaaugagguggccaaaaacuuaaacgaaucucucaucgaccugcaggagcuugggaaguaugagcaguacauuaaauggcccugguauaucuggcugggauucauugcuggccuaaucgcaauagucauggugaccaucaugcucugcuguaugacuuccugcuguucaugccugaaggguuguugcaguuguggcagcugcugcaaauuugacgaagaugacuccgagccuguuuugaaggggguaaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12988 - RNA, 4039 nt, Artificial Sequence
  SARS-CoV-2/France/HF2496/2020__EPI_ISL_418231 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgucgcacgugauuugauuugcgcccagaaguucaacggccugaccgugcugcccccacucuuaacagacgaaaugaucgcucaguauacgucagcccugcuugcagguaccauuacgaguggguggacauuuggcgcuggagccgcguugcagaucccuuucgccaugcaaauggcuuaccgguuuaauggcauaggggugacccagaacguccucuaugagaaucagaaacugauugcaaaccaguucaacuccgccaucggaaagauucaagauucucuaagcuccacagcuucagcccugggcaaacuccaggacguugugaaucagaacgcacaggcgcugaauacucuuguaaagcaauugagcaguaacuuuggugccaucucuuccgugcugaaugacauauuaagccgacucgauaaggucgaagcugaggugcagaucgacagacugauuaccgggaggcuucagucgcugcaaacguacguuacacagcaguugauccgcgccgcagagauucgggcuucagccaaccucgcagccaccaaaaugucugaaugcgugcugggacagaguaagagagucgauuucuguggcaaagguuaccaccuaauguccuuuccccaaagcgcuccacauggcgugguuuuccugcacgugacuuaugucccggcgcaggagaagaauuuuaccacagccccugcaaucugccacgacgggaaagcucauuuccccagggaaggaguauuugugucuaacggcacucacugguucguuacccagcgcaauuuuuacgagccacagauaauuacaacggauaacaccuucgugagcgggaauugugacgucgugaucggaaucguaaacaauacuguguaugauccccuccaaccugagcuggacuccuucaaggaagaacuugauaaauacuuuaagaaccauacaucaccagacgucgauuugggcgacauuagugguaucaaugccagcguugugaacauucagaaggaaauagaucgacugaaugagguggccaaaaacuuaaacgaaucucucaucgaccugcaggagcuugggaaguaugagcaguacauuaaauggcccugguauaucuggcugggauucauugcuggccuaaucgcaauagucauggugaccaucaugcucugcuguaugacuuccugcuguucaugccugaaggguuguugcaguuguggcagcugcugcaaauuugacgaagaugacuccgagccuguuuugaaggggguaaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12989 - RNA, 4039 nt, Artificial Sequence
  SARS-CoV-2/USA/WA-UW291/2020__EPI_ISL_418076 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgcagcccgugauuugauuugcgcucagaaguucaacggccugaccguccugcccccacucuuaacagacgaaaugaucgcccaguauacgucagcacugcuugcugguaccauuacgaguggguggacauuuggcgccggagcggccuugcagaucccuuucgcuaugcaaauggcauaccgguuuaauggcauaggggugacccagaacgugcucuaugagaaucagaaacugauugccaaccaguucaacuccgcuaucggaaagauucaauacucucuaagcuccacagccucagcacugggcaaacuccaggaugucguuaaucagaacgcgcaggcccugaauacucuugugaagcaauugagcaguaacuuuggugcuaucucuuccguacugaaugacauauuaagccgacucgacaagguggaagccgagguccagaucgauagacugauuaccgggaggcuucagucgcugcaaacguacgugacacagcaguugauccgcgcagcugagauucgggccucagcaaaccucgccgcuaccaaaaugucugaaugcguucugggacagaguaagagaguggacuucuguggcaaagguuaucaccuaauguccuuuccccaaagcgcgccacauggcgucguguuccugcacguuacuuacgugccggcccaggagaagaauuuuaccacagcuccugcaaucugccacgaugggaaagcccauuuccccagggaaggagucuuuguaucuaacggcacucacugguucgugacccagcgcaauuuuuaugagccacagauaauuacaacggacaacaccuucguuagcgggaauugugauguggucaucggaaucgugaacaauacuguauacgacccccuccaaccugagcuggauuccuucaaggaagaacuugacaaauauuuuaagaaccauacaucaccagauguggacuugggcgauauuagugguaucaaugccagcgucguuaacauucagaaggaaauagaccgacugaaugagguggcuaaaaacuuaaacgaaucucucaucgaucugcaggagcuugggaaguacgagcaguauauuaaauggcccugguacaucuggcugggauucauugcaggccuaaucgccauagugauggucaccaucaugcucugcuguaugacuuccugcuguucaugccugaaggguuguugcaguuguggcagcugcugcaaauuugacgaagacgauuccgagccuguguugaaggggguuaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12990 - RNA, 4039 nt, Artificial Sequence
  SARS-CoV-2/Portugal/PT0034/2020__EPI_ISL_418019 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgcagcccgugauuugauuugcgcucagaaguucaacggccugaccguccugcccccacucuuaacagacgaaaugaucgcccaguauacgucagcacugcuugcugguaccauuacgaguggguggacauuuggcgccggagcggccuugcagaucccuuucgcuaugcaaauggcauaccgguuuaauggcauaggggugacccagaacgugcucuaugagaaucagaaacugauugccaaccaguucaacuccgcuaucggaaagauucaagauucucuaagcuccacagccucagcacugggcaaacuccaggacgucguuaaucagaacgcgcaggcccugaauacucuugugaagcaauugagcaguaacuuuggugcuaucucuuccguacugaaugacauauuaagccgacucgauaagguggaagccgagguccagaucgacagacugauuaccgggaggcuucagucgcugcaaacguacgugacacagcaguugauccgcgcagcugagauucgggccucagcaaaccucgccgcuaccaaaaugucugaaugcguucugggacagaguaagagaguggauuucuguggcaaagguuaccaccuaauguccuuuccccaaagcgcgccacauggcgucguguuccugcacguuacuuaugugccggcccaggagaagaauuuuaccacagcuccugcaaucugccacgacgggaaagcccauuuccccagggaaggagucuuuguaucuaacggcacucacugguucgugacccagcgcaauuuuuacgagccacagauaauuacaacggauaacaccuucguuagcgggaauugugacguggucaucggaaucgugaacaauacuguauaugauccccuccaaccugagcuggacuccuucaaggaagaacuugauaaauacuuuaagaaccauacaucaccagacguggauuugggcgacauuagugguaucaaugccagcgucguuaacauucagaaggaaauagaucgacugaaugagguggcuaaaaacuuaaacgaaucucucaucgaccugcaggagcuugggaaguaugagcaguacauuaaauggcccugguauaucuggcugggauucauugcaggccuaaucgccauagugauggucaccaucaugcucugcuguauuacuuccugcuguucaugccugaaggguuguugcaguuguggcagcugcugcaaauuugacgaagaugacuccgagccuguguugaaggggguuaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12991 - RNA, 4039 nt, Artificial Sequence
  SARS-CoV-2/Iceland/202/2020__EPI_ISL_417750 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacaggaaguuuucgcgcaagugaagcagauuuauaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauacggcgacugucuuggggauaucgcagcccgugacuugauuugcgcucagaaguucaacggacugaccguccugcccccacucuuaacagaugaaaugaucgcccaguauacgucagcacugcuugcuggcaccauuacgagugguuggacauuuggggccggcgcggccuugcagaucccuuucgcuaugcaaauggcauaccgguuuaauggaauaggcgugacccagaacgugcucuaugagaaucagaaacugauugccaaccaguucaacuccgcuaucgggaagauucaagacucucuaagcuccacagccucagcacugggaaaacuccaggacgucguuaaucagaacgcgcaggcccugaauacucuugugaagcaauugagcaguaacuuuggcgcuaucucuuccguacugaaugauauauuaagccgacucgacaagguggaagccgagguccagaucgauagacugauuaccgguaggcuucagucgcugcaaacguacgugacacagcaguugauccgcgcagcugagauucgggccucagcaaaccucgccgcuaccaaaaugucugaaugcguucuggggcagaguaagagaguggacuucuguggaaaaggcuaccaccuaauguccuuuccccaaagcgcgccacauggugucguguuccugcacguuacuuaugugccggcccaggagaagaauuuuaccacagcuccugcaaucugccacgauggcaaagcccauuuccccagggaaggggucuuuguaucuaacggaacucacugguucgugacccagcgcaauuuuuacgagccacagauaauuacaacggacaacaccuucguuagcggcaauugugauguggucaucgggaucgugaacaauacuguauaugacccccuccaaccugagcuggauuccuucaaggaggaacuugacaaauacuuuaagaaccauacaucaccagauguggacuugggagauauucccggcaucaaugccagugucguuaacauucagaaggaaauagaccgacugaaugagguggcuaaaaacuuaaacgaaagccucaucgaccugcaggagcuugguaaguaugagcaguacauuaaauggccuugguauaucuggcugggguucauugcaggacuaaucgccauagugauggucaccaucaugcucugcuguaugacuucuugcuguuccugccugaagggcuguugcucaugugguaguugcugcaaauuugaugaagacgauagcgagccgguguugaagggcguuaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12992 - RNA, 4039 nt, Artificial Sequence
  SARS-CoV-2/USA/WA-UW261/2020__EPI_ISL_418046 spike protein mRNA human (1-1273)
aggagaaagcuuaccauguucguguuucugguccuccuuccccugguuagcucccagugcgugaacuugaccacaagaacucaauuaccuccagccuacacgaauagcuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucacaucggucuaugcguggaaucgaaagagaaucucuaacuguguggcagacuacuccguacuuuacaauucagccaguuuuagcacuuucaaaugcuauggcguuuccccaaccaagcugaacgacuuguguuuuacaaauguguacgcugauucuuucgucauuaggggugacgaagugcggcagaucgcccccgggcaaacuggaaaaaucgcagauuauaacuacaagcuaccggacgauuuuaccggcugcgucauugcuuggaauagcaacaaccuggacucaaaagugggcgggaauuauaacuaccucuaucgucuguuccgcaagaguaaucuuaagccuuuugagagagauauauccacagaaaucuaccaggccggaagcacccccuguaacgguguugagggcuucaauugcuacuuuccacugcagucuuauggguuccaaccuacuaacggagugggcuaccagcccuauaggguagucguguugucauuugaacuccugcacgcgccagccacgguuugcggucccaaaaagaguacaaauuuagugaaaaacaagugugucaauuucaacuuuaaugggcugaccggcacuggagugcuaaccgagagcaacaaaaaguuccucccuuuccagcaguuuggccgggacauugcagauacaaccgacgcuguacgagauccacaaacucuggagauccuugacauaacaccgugcuccuucgggggagugucuguuauuacgcccgguaccaauacuucgaaccaggucgccguguuguaccaggacgugaauuguacagaagucccuguugcuauccacgccgaucagcugaccccaacauggcgcguguauagcacuggcuccaacguguuucaaaccagagcagggugccucaucggagccgagcauguaaacaauucauacgaaugugacauucccaucggcgcugguauuugcgcgaguuaucagacgcagaccaacucuccuaggcgggcacgcagcgucgccucccagucaauaaucgcuuacacaaugagccugggggccgaaaauucuguggcauacuccaacaauaguauugccaucccaacuaacuucaccaucagcguuacaacugaaauucuucccgugucuaugaccaagacguccgucgauuguacaauguauauaugcggcgacucaaccgaguguaguaaucuguugcuccaauacggaucuuuuugcacucagcugaacagagcuuuaacaggcaucgccguggagcaggauaaaaauacccaggaaguuuucgcacaagugaagcagauuuauaaaacuccgccuaucaaggacuuugggggauucaacuuuucgcagauucugccagaucccuccaaaccuucuaagaggagcuucaucgaggaccuacucuuuaauaagguaacccuggcggaugcugguuucauaaaacaauacggcgacugucuuggggauaucgccgcacgugacuugauuugcgcccagaaguucaacggacugacaguccugcccccacucuuaacggaugaaaugaucgcucaguauaccucagcccugcuugcaggcacuauuacaagugguuggaccuuuggggcuggcgccgcguugcagaucccuuucgccaugcaaauggcuuaccgguuuaauggaauaggcgugacacagaacgugcucuaugagaaucagaaacugauugcaaaccaguucaacuccgccaucgggaagauucaagacucucuaagcuccacugcuucagcccugggaaaacuccaggacgucguuaaucagaacgcacaggcgcugaauacccuugugaagcaauugagcaguaacuuuggcgccaucucuuccguacugaaugauauauuaagccgacucgacaagguggaagcugagguccagaucgauagacugauuacggguaggcuucagucgcugcaaacauacgugacccagcaguugauccgcgccgcagagauucgggcuucagccaaccucgcagccacuaaaaugucugaaugcguucuggggcagaguaagagaguggacuucuguggaaaaggcuaccaccuaauguccuuuccccaaagcgcuccacauggugucguguuccugcacguuaccuaugugccggcgcaggagaagaauuuuacaacugccccugcaaucugccacgauggcaaagcucauuuccccagggaaggggucuuuguaucuaacggaacccacugguucgugacacagcgcaauuuuuacgagccacagauaauuacgaccgacaacacuuucguuagcggcaauugugauguggucaucgggaucgugaacaauacaguauaugacccccuccaaccugagcuggauuccuucaaggaagaacuugacaaauacuuuaagaaccauaccucaccagauguggacuugggagauauuaguggcaucaaugccagcgucguuaacauucagaaggaaauagaccgacugaaugagguggccaaaaacuuaaacgaaucucucaucgaccugcaggagcuugguaaguaugagcaguacauuaaauggcccugguauaucuggcugggguucauugcuggacuaaucgcaauagugauggucacuaucaugcucugcuguaugacauccugcuguucaugccugaagggcuguugcaguugugguagcugcugcaaauuugaugaagacgauuccgagccuguguugaagggcguuaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12993 - RNA, 4039 nt, Artificial Sequence
  SARS-CoV-2/Portugal/PT0035/2020__EPI_ISL_418020 spike protein mRNA human (1-1273)
aggagaaagcuuaccauguucguguuucugguccuccuuccccugguuagcucccagugcgugaacuugaccacaagaacucaauuaccuccagccuacacgaauagcuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggaucuuuuugcacccagcugaacagagccuuaacuggcaucgcaguggagcaggauaaaaauacacaggaaguuuucgcgcaagugaagcagauuuauaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauacggcgacugucuuggggauaucucagcacgugacuugauuugcgcccagaaguucaacggacugaccguccugcccccacucuuaacagaugaaaugaucgcucaguauacgagugcccugcuugcaggcaccauuacuuccgguuggacauuuggggcuggcgccgcguugcagaucccuuucgccaugcaaauggcuuaccgguuuaauggaauaggcgugacccagaacgugcucuaugagaaucagaaacugauugcaaaccaguucaacucugccaucgggaagauucaagacagccuauccucaacagcuagcgcccugggaaaacuccaggacgucguuaaucagaacgcacaggcgcugaauacucuugugaagcaauugaguucuaacuuuggcgccaucuccagcguacugaaugauauauuaucgcgacucgacaagguggaagcugagguccagaucgauagacugauuaccgguaggcuucagucacugcaaacguacgugacacagcaguugauccgcgccgcagagauucgggcuucugccaaccucgcagccaccaaaaugagugaaugcguucuggggcaguccaagagaguggacuucuguggaaaaggcuaccaccuaaugagcuuuccccaaucugcuccacauggugucguguuccugcacguuacuuaugugccggcgcaggagaagaauuuuaccacagccccugcaaucugccacgauggcaaagcucauuuccccagggaaggggucuuuguaagcaacggaacucacugguucgugacccagcgcaauuuuuacgagccacagauaauuacaacggacaacaccuucguuuccggcaauugugauguggucaucgggaucgugaacaauacuguauaugacccccuccaaccugagcuggauucauucaaggaagaacuugacaaauacuuuaagaaccauacaaguccagauguggacuugggagauauuagcggcaucaaugccucugucguuaacauucagaaggaaauagaccgacugaaugagguggccaaaaacuuaaacgaaucccucaucgaccugcaggagcuugguaaguaugagcaguacauuaaauggcccugguauaucuggcugggguucauugcuggacuaaucgcaauagugauggucaccaucaugcucugcuguaugacuucaugcuguaguugccugaagggcuguugcagcugugguuccugcugcaaauuugaugaagacgauucugagccuguguugaagggcguuaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12994 - RNA, 4039 nt, Artificial Sequence
  SARS-CoV-2/USA/NY-NYUMC7/2020__EPI_ISL_418192 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuaccaucacaaaaauaacaaguccuggauggagucugaguuccguguguauagcuccgcgaauaacuguacuuuugaguacgugucacaaccuuuccugauggaccuggaaggcaagcaggguaauuuuaaaaaccucagagaguucgucuuuaagaacauugauggguauuucaaaaucuacaguaagcauaccccaauaaauuuaguuagggaccugccccagggauuuagcgcucuugagccuuugguggaucugccaaucggcauuaacaucacacgguuccagacucuacucgcccugcaccgcucuuaccuuaccccgggcgacuccucaagcggguggacagcaggagccgcugcauauuacguagguuaucugcaacccagaaccuuuuugcucaaauacaaugaaaacggcacgauuacugaugccguggacugcgcucuggauccuuuaagugagacaaaguguacccugaagucuuucacugucgaaaaagggaucuaucagacauccaauuuuagggugcagccaaccgagagcauaguucgguuccccaacauuacgaaucucugcccuuuuggagagguguucaacgccacccgcuucgcgucggucuacgcauggaaucgaaagagaaucucuaacuguguggccgacuauuccguacuuuacaauucagcuaguuuuagcacauucaaaugcuacggcguuuccccaacuaagcugaacgacuuguguuuuaccaauguguaugccgauucuuucgucauuaggggugacgaagugcggcagaucgcacccgggcaaacaggaaaaaucgcugauuacaacuauaagcuaccggacgauuuuacuggcugcgucauugccuggaauagcaacaaccuggacucaaaagugggcgggaauuacaacuaucucuaccgucuguuccgcaagaguaaucuuaagccuuuugagagagauauauccaccgaaaucuaucaggcgggaagcacacccuguaacgguguugagggcuucaauugcuacuuuccacugcagucuuacggguuccaaccuaccaacggagugggcuaucagcccuacaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaucagggcgugaauuguacugaagucccuguugccauccaugcagaccagcugacaccaaccuggcgcguguacagcacaggguccaacguguuucaaacuagagccggaugccucaucggcgcugagcacguaaacaauucauaugaaugugauauucccaucggugcggggauuugcgcaaguuaccagacccagacgaacucuccuaggcgggcccgcagcgucgcuucccagucaauaaucgccuauaccaugagccugggcgcagaaaauucuguggccuacuccaacaauaguauugcuaucccaacaaacuucacuaucagcguuaccacagaaauucuucccgugucuaugacuaagaccuccgucgacuguacgauguacauaugcggagauucaacagaguguaguaaucuguugcuccaauauggcagcuuuugcacccagcugaacagagccuuaacugggaucgcaguggagcaggacaaaaauacacaggaaguuuucgcgcaagugaagcagauuuacaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauauggggauugucuuggagacaucgcagcccgugauuugauuugcgcucagaaguucaacggccugaccguccugcccccacucuuaacagacgaaaugaucgcccaguacacgucagcacugcuugcugguaccauuacgaguggguggacauuuggcgccggagcggccuugcagaucccuuucgcuaugcaaauggcauaucgguuuaauggcauaggggugacccagaacgugcucuacgagaaucagaaacugauugccaaccaguucaacuccgcuaucggaaagauucaagauucucuaagcuccacagccucagcacugggcaaacuccaggacgucguuaaucagaacgcgcaggcccugaauacucuugugaagcaauugagcaguaacuuuggugcuaucucuuccguacugaaugacauauuaagccgacucgauaagguggaagccgagguccagaucgacagacugauuaccgggaggcuucagucgcugcaaacguaugugacacagcaguugauccgcgcagcugagauucgggccucagcaaaccucgccgcuaccaaaaugucugaaugcguucugggacagaguaagagaguggauuucuguggcaaagguuaccaucuaauguccuuuccccaaagcgcgccacacggcgucguguuccugcacguuacuuacgugccggcccaggagaagaauuuuaccacagcuccugcaaucugccaugacgggaaagcccacuuccccagggaaggagucuuuguaucuaacggcacucauugguucgugacccagcgcaauuuuuaugagccacagauaauuacaacggauaacaccuucguuagcgggaauugugacguggucaucggaaucgugaacaauacuguauacgauccccuccaaccugagcuggacuccuucaaggaagaacuugauaaauauuuuaagaaccacacaucaccagacguggauuugggcgacauuagugguaucaaugccagcgucguuaacauucagaaggaaauagaucgacugaaugagguggcuaaaaacuuaaacgaaucucucaucgaccugcaggagcuugggaaguacgagcaguauauuaaauggcccugguacaucuggcugggauucauugcaggccuaaucgccauagugauggucaccaucaugcucugcuguaugacuuccugcuguucaugccugaaggguuguugcaguuguggcagcugcugcaaauuugacgaagaugacuccgagccuguguugaaggggguuaagcugcauuauacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12995 - RNA, 4039 nt, Artificial Sequence
  SARS-CoV-2/Iceland/189/2020__EPI_ISL_417709 spike protein mRNA human (1-1273)
aggagaaagcuuaccauguucguguuucugguccuccuuccccugguuagcucccagugcgugaacuugaccacaagaacucaauuaccuccagccuacaccaauucuuucacgaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucaccaaacaauacggggauugucuuggagacauagcagcccgugauuugaucugcgcucagaaguucaacggccugacaguccucccuccacuguuaacggacgaaaugauugcccaguauaccucagcacugcuugcugguacuaucacaaguggguggaccuuuggcgccggagcggccuugcagauuccuuucgcuaugcaaauggcauaccgguuuaauggcaucggggugacacagaacgugcucuaugagaaucagaaacugauagccaaccaguucaacuccgcuauuggaaagauccaagauucucuaagcuccacugccucagcacugggcaaacuccaggacgucguuaaucagaacgcgcaggcccugaauacccuugugaagcaauugagcaguaacuuuggugcuauuucuuccguacugaaugacaucuuaagccgacucgauaagguggaagccgagguccagauagacagacugaucacggggaggcuucagucgcugcaaacauacgugacccagcaguugauucgcgcagcugagauccgggccucagcaaaccucgccgcuacuaaaaugucugaaugcguucugggacagaguaagagaguggauuucuguggcaaagguuaccaccuaauguccuuuccccaaagcgcgccacauggcgucguguuccugcacguuaccuaugugccggcccaggagaagaauuuuacaacugcacccgcuauuugccacgacgggaaagcccauuuccccagggaaggagucuuuguaucuaacggcacccacugguucgugacacagcgcaauuuuuacgagccacagaucauaacgaccgauaacacuuucguuagcgggaauugugacguggucauuggaaucgugaacaauacaguauaugauccccuccaaccugagcuggacuccuucaaggaagaacuugauaaauacuuuaagaaccauaccucaccagacguggauuugggcgacaucagugguauuaaugccagcgucguuaacauccagaaggaaauugaucgacugaaugagguggcuaaaaacuuaaacgaaucucucauagaccugcaggagcuugggaaguaugagcaguacaucaaauggcccugguauauuuggcugggauucaucgcaggccuaauugccaucgugauggucacuauaaugcucugcuguaugacauccugcuguucaugccugaaggguuguugcaguuguggcagcugcugcaaauuugacgaagaugacuccgagccuguguugaaggggguuaagcugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12996 - RNA, 4039 nt, Artificial Sequence
  SARS-CoV-2/Australia/NSW56/2020__EPI_ISL_417408 spike protein mRNA human (1-1273)
aggagaaagcuuaccauguucguguuucugguccuccuuccccugguuagcucccagugcgugaacuugaccacaagaacucaauuaccuccagccuacacgaauagcuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggaucuuuuugcacccagcugaacagagccuuaacuggcaucgcaguggagcaggauaaaaauacacaggaaguuuucgcgcaagugaagcagauuuauaaaaccccgccuaucaaggacuuugggggauucaacuuuucgcagauucugccagauuccucuaaacccagcaagaggucauucaucgaggaccuacucuuuaauaagguaacucuggcugaugccgguuucauaaaacaauacggcgacugucuuggggauaucgcagcccgugacuugauuugcgcucagaaguucaacggacugaccguccucccuccccuguuaacagaugaaaugaucgcccaguauacgagugcacugcuugcuggcaccauuacuuccgguuggacauuuggggccggcgcggccuugcagaucccauucgcuaugcaaauggcauaccgguuuaauggaauaggcgugacccagaacgugcucuaugagaaucagaaacugauugccaaccaguucaacucugcuaucgggaagauucaagacagccuauccucaacagccagcgcacugggaaaacuccaggacgucguuaaucagaacgcgcaggcccugaauacucuugugaagcaauugaguucuaacuuuggcgcuaucuccagcguacugaaugauauauuaucgcgacucgacaagguggaagccgagguccagaucgauagacugauuaccgguaggcuucagucacugcaaacguacgugacacagcaguugauccgcgcagcugagauucgggccucugcaaaccucgccgcuaccaaaaugagugaaugcguucuggggcaguccaagagaguggacuucuguggaaaaggcuaccaccuaaugagcuuuccucaaucugcgccccauggugucguguuccugcacguuacuuaugugccagcccaggagaagaauuuuaccacagcaccggcuaucugccacgauggcaaagcccauuucccuagggaaggggucuuuguaagcaacggaacucacugguucgugacccagcgcaauuuuuacgagccccagauaauuacaacggacaacaccuucguuuccggcaauugugauguggucaucgggaucgugaacaauacuguauaugacccacuccaacccgagcuggauucauucaaggaagaacuugacaaauacuuuaagaaccauacaaguccugauguggacuugggagauauuagcggcaucaaugccucugucguuaacauucagaaggaaauagaccgacugaaugagguggcuaaaaacuuaaacgaaucccucaucgaccugcaggagcuugguaaguaugagcaguacauuaaauggccaugguauaucuggcugggguucauugcaggacuaaucgccauagugauggucaccaucaugcucugcuguaugacuucaugcuguaguugccugaagggcuguugcagcugugguuccugcugcaaauuugaugaagacgauucugagcccguguugaagggcguuaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12997 - RNA, 4039 nt, Artificial Sequence
  SARS-CoV-2/Iceland/280/2020__EPI_ISL_417608 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucacacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaguacggcagcuuuugcacccaacugaacagagccuuaacugggaucgcaguggagcaggacaaaaauacacaggaaguuuucgcacaggugaagcaaauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaguacggggauugucuuggagacaucgcagcccgugauuugauuugcgcucaaaaguucaacggccugaccguccugcccccacucuuaacagacgaaaugaucgcccaguauacgucagcacugcuugcugguaccauuacgaguggguggacauuuggcgccggagcggccuugcagaucccuuucgcuaugcagauggcauaccgguuuaauggcauaggggugacccaaaacgugcucuaugagaaucagaaacugauugccaaccaguucaacuccgcuaucggaaagauucaggauucucuaagcuccacagccucagcacugggcaaacuccaagacgucguuaaucagaacgcgcaggcccugaauacucuugugaagcaguugagcaguaacuuuggugcuaucucuuccguacugaaugacauauuaagccgacucgauaagguggaagccgagguccaaaucgacagacugauuaccgggaggcuucagucgcugcagacguacgugacacaacaguugauccgcgcagcugagauucgggccucagcaaaccucgccgcuaccaaaaugucugaaugcguucugggacagaguaagagaguggauuucuguggcaaagguuaccaucuaauguccuuuccccagagcgcgccacacggcgucguguuccugcacguuacuuaugugccggcccaagagaagaauuuuaccacagcgccugcuaucugccaugacgggaaagcccacuuccccagggaaggagucuuuguaucuaacggcacucauugguucgugacccagcgcaauuuuuacgagccacagauaauuacaacggauaacaccuucguuagcgggaauugugacguggucaucggaaucgugaacaauacuguauaugauccccuccagccugagcuggacuccuucaaggaagaacuugauaaauacuuuaagaaccacacaucaccagacguggauuugggcgacauuagugguaucaaugccagcgucguuaacauucaaaaggaaauagaucgacugaaugagguggcuaaaaacuuaaacgaaucucucaucgaccugcaggagcuugggaaguaugagcaguacauuaaauggcccugguauaucuggcugggauucauugcaggccuaaucgccauagugauggucaccaucaugcucugcuguaugacuuccugcuguucaugccugaaggguuguugcaguuguggcagcugcugcaaauuugacgaagaugacuccgagccuguguugaaggggguuaagcugcauuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12998 - RNA, 4039 nt, Artificial Sequence
  SARS-CoV-2/Iceland/247/2020__EPI_ISL_417575 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauacggggauugucuuggagacaucgcagcccgugauuugauuugcgcucagaaguucaacggccugaccguccugcccccacucuuaacagacgaaaugaucgcccaguauacgucagcacugcuugcugguaccauuacgaguggguggacauuuggcgccggagcggccuugcagaucccuuucgcuaugcaaauggcauaccgguuuaauggcauaggggugacccagaacgugcucuaugagaaucagaaacugauugccaaccaguucaacuccgcuaucggaaagauucaagauucucuaagcuccacagccucagcacugggcaaacuccaggacgucguuaaucagaacgcgcaggcccugaauacucuugugaagcaauugagcaguaacuuuggugcuaucucuuccguacugaaugacauauuaagccgacucgauaagguggaagccgagguccagaucgacagacugauuaccgggaggcuucagucgcugcaaacguacgugacacagcaguugauccgcgcagcugagauucgggccucagcaaaccucgccgcuaccaaaaugucugaaugcguucugggacagaguaagagaguggauuucuguggcaaagguuaccaccuaauguccuuuccccaaagcgcgccacauggcgucguguuccugcacguuacuuaugugccggcccaggagaagaauuuuaccacagcuccugcaaucugccacgacgggaaagcccauuuccccagggaaggagucuuuguaucuaacggcacucacugguucgugacccagcgcaauuuuuacgagccacagauaauuacaacggauaacaccuucguuagcgggaauugugacguggucaucggaaucgugaacaauacuguauaugauccccuccaaccugagcuggacuccuucaaggaagaacuugauaaauacuuuaagaaccauacaucaccagacguggauuugggcgacauuagugguaucaaugccagcgucguuaacauucagaaggaaauagaucgacugaaugagguggcuaaaaacuuaaacgaaucucucaucgaccugcaggagcuugggaaguaugagcaguacauuaaauggcccugguauaucuggcugggauucauugcaggccuaaucgccauagugaucgucaccauuaugcucugcuguaugacuuccugcuguucaugccugaaggguuguugcaguuguggcagcugcugcaaauuugacgaagaugacuccgagccuguguugaaggggguuaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 12999 - RNA, 4039 nt, Artificial Sequence
  SARS-CoV-2/Iceland/238/2020__EPI_ISL_417566 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggaucuacucuuuaauaagguaacucuggcugacgucggcuucauaaaacaauacggggauugucuuggagacaucgccgcacgugauuugauuugcgcccagaaguucaacggccugaccgugcugcccccacucuuaacagacgaaaugaucgcucaguauacgucagcccugcuugcagguaccauuacgaguggguggacauuuggcgcuggagccgcguugcagaucccuuucgccaugcaaauggcuuaccgguuuaauggcauaggggugacccagaacguccucuaugagaaucagaaacugauugcaaaccaguucaacuccgccaucggaaagauucaagauucucuaagcuccacagcuucagcccugggcaaacuccaggacguugugaaucagaacgcacaggcgcugaauacucuuguaaagcaauugagcaguaacuuuggugccaucucuuccgugcugaaugacauauuaagccgacucgauaaggucgaagcugaggugcagaucgacagacugauuaccgggaggcuucagucgcugcaaacguacguuacacagcaguugauccgcgccgcagagauucgggcuucagccaaccucgcagccaccaaaaugucugaaugcgugcugggacagaguaagagagucgauuucuguggcaaagguuaccaccuaauguccuuuccccaaagcgcuccacauggcgugguuuuccugcacgugacuuaugucccggcgcaggagaagaauuuuaccacagccccugcaaucugccacgacgggaaagcucauuuccccagggaaggaguauuugugucuaacggcacucacugguucguuacccagcgcaauuuuuacgagccacagauaauuacaacggauaacaccuucgugagcgggaauugugacgucgugaucggaaucguaaacaauacuguguaugauccccuccaaccugagcuggacuccuucaaggaagaacuugauaaauacuuuaagaaccauacaucaccagacgucgauuugggcgacauuagugguaucaaugccagcguugugaacauucagaaggaaauagaucgacugaaugagguggccaaaaacuuaaacgaaucucucaucgaccugcaggagcuugggaaguaugagcaguacauuaaauggcccugguauaucuggcugggauucauugcuggccuaaucgcaauagucauggugaccaucaugcucugcuguaugacuuccugcuguucaugccugaaggguuguugcaguuguggcagcugcugcaaauuugacgaagaugacuccgagccuguuuugaaggggguaaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13000 - RNA, 4039 nt, Artificial Sequence
  SARS-CoV-2/Greece/16/2020__EPI_ISL_418265 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacguugauggguacuucaaaauuuacaguaagcacaccccaaucaauuuagugagggaccugccccagggauuuagcgcucuugagccuuugguagaucugccaauaggcaucaacauuacacgguuccagacucuacucgcccugcaucgcucuuaucuuaccccgggcgacuccucaagcggguggacagcaggagccgcugcauacuauguggguuaccugcaacccagaaccuuuuugcucaaauauaaugaaaacggcacgaucacugaugccgucgacugcgcucuggauccuuuaagugagacaaaguguacccugaagucuuucacuguggaaaaagggauuuaccagacauccaauuuuaggguucagccaaccgagagcaucgugcgguuccccaacauaacgaaucucugcccuuuuggagaggucuucaacgccacccgcuucgcgucgguguaugcauggaaucgaaagagaauuucuaacuguguagccgacuacuccguucuuuacaauucagcuaguuuuagcacauucaaaugcuauggcguguccccaacuaagcugaacgacuuguguuuuaccaaugucuacgccgauucuuucgugaucaggggugacgaaguccggcagauugcacccgggcaaacaggaaaaaucgcugauuauaacuacaagcuaccggacgauuuuacuggcugcgugaucgccuggaauagcaacaaccuggacucaaaaguuggcgggaauuauaacuaccucuaucgucuguuccgcaagaguaaucuuaagccuuuugagagagauauuuccaccgaaauauaccaggcgggaagcacacccuguaacgguguggagggcuucaauugcuacuuuccacugcagucuuauggguuccaaccuaccaacggaguaggcuaccagcccuauagggucgugguuuugucauuugaacuccugcacgccccagcaacugugugcggucccaaaaagaguacgaauuuagucaaaaacaagugugugaauuucaacuuuaaugggcugacaggcaccggaguacuaacugagagcaacaaaaaguuccucccuuuccagcaguuuggccgggacaucgcugauaccacagacgccgugcgagauccacaaacccuggagauucuugacaucacuccgugcuccuucgggggaguuucugucauaacacccgguacgaauaccucgaaccagguggcuguguuguaccaggacgucaauuguacugaaguuccuguggccauucacgcagaucagcugacaccaaccuggcgcguguauagcacaggcuccaacguauuucaaacuagagccgggugccucaucggagcugagcaugucaacaauucauacgaaugugacauccccauuggcgcggguaucugcgcaaguuaucagacccagacgaacucuccuaggcgggcccgcagcguggcuucccagucaauuauagccuacaccaugagccugggggcagaaaauucuguugccuacuccaacaauaguaucgcuauuccaacaaacuucacuaucagcgugaccacagaaauccuucccgucucuaugacuaagaccuccguggauuguacgauguauauuugcggcgacucaacagaguguaguaaucuguugcuccaauacggcagcuuuugcacccagcugaacagagccuuaacuggaauagcaguugagcaggauaaaaauacacaggaaguguucgcgcaaguaaagcagaucuauaaaaccccgccuauuaaggacuuugggggauucaacuuuucgcagauccugccagaucccuccaaaccuucuaagaggagcuucauugaggaccuacucuuuaauaaggucacucuggcugaugccgguuucaucaaacaauacggcgacugucuuggggauauagcagcccgugacuugaucugcgcucagaaguucaacggacugaccgugcugcccccacucuuaacagaugaaaugauugcccaguauacgucagcacugcuugcuggcaccaucacgagugguuggacauuuggggccggcgcggccuugcagauuccuuucgcuaugcaaauggcauaccgguuuaauggaaucggcgugacccagaacguccucuaugagaaucagaaacugauagccaaccaguucaacuccgcuauugggaagauccaagacucucuaagcuccacagccucagcacugggaaaacuccaggacguugugaaucagaacgcgcaggcccugaauacucuuguaaagcaauugagcaguaacuuuggcgcuauuucuuccgugcugaaugauaucuuaagccgacucgacaaggucgaagccgaggugcagauagauagacugaucaccgguaggcuucagucgcugcaaacguacguuacacagcaguugauucgcgcagcugagauccgggccucagcaaaccucgccgcuaccaaaaugucugaaugcgugcuggggcagaguaagagagucgacuucuguggaaaaggcuaccaccuaauguccuuuccccaaagcgcgccacauggugugguuuuccugcacgugacuuaugucccggcccaggagaagaauuuuaccacagcuccugcaauuugccacgauggcaaagcccauuuccccagggaagggguauuugugucuaacggaacucacugguucguuacccagcgcaauuuuuacgagccacagaucauaacaacggacaacaccuucgugagcggcaauugugaugucgugauugggaucguaaacaauacuguguaugacccccuccaaccugagcuggauuccuucaaggaggaacuugacaaauacuuuaagaaccauacaucaccagaugucgacuugggagauaucaguggcauuaaugccagcguugugaacauccagaaggaaauugaccgacugaaugagguggcuaaaaacuuaaacgaaucucucauagaccugcaggagcuugguaaguaugagcaguacaucaaauggcccugguauauuuggcugggguucaucgcaggacuaauugccaucgucauggugaccauaaugcucugcuguaugacuuccugcuguucaugccugaagggcuguugcaguugugguagcugcugcaaauuugaugaagacgauuccgagccuguuuugaagggcguaaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13001 - RNA, 4039 nt, Artificial Sequence
  SARS-CoV-2/Iceland/319/2020__EPI_ISL_417648 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauugaccuggaaggcaagcaggguaauuuuaaaaaccucagagaguucgucuuuaagaacaucgauggguacuucaaaauauacaguaagcacaccccaaucaauuuaguuagggaccugccccagggauuuagcgcucuugagccuuugguggaucugccaauuggcaucaacauuacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgaucacugaugccguggacugcgcucuggauccuuuaagugagacaaaguguacccugaagucuuucacugucgaaaaagggauauaccagacauccaauuuuagggugcagccaaccgagagcauuguucgguuccccaacaucacgaaucucugcccuuuuggagagguguucaacgccacccgcuucgcgucggucuaugcauggaaucgaaagagaauuucuaacuguguggccgacuacuccguacuuuacaauucagcuaguuuuagcacauucaaaugcuauggcguuuccccaacuaagcugaacgacuuguguuuuaccaauguguacgccgauucuuucgucaucaggggugacgaagugcggcagaucgcacccgggcaaacaggaaaaauugcugauuauaacuacaagcuaccggacgauuuuacuggcugcgucauagccuggaauagcaacaaccuggacucaaaagugggcgggaauuauaacuaccucuaucgucuguuccgcaagaguaaucuuaagccuuuugagagagauaucuccaccgaaauuuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacaucgcugauaccacagacgccguacgagauccacaaacccuggagauacuugacauuacuccgugcuccuucgggggagugucuguuaucacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucauuggcgcugagcauguaaacaauucauacgaaugugauauccccauuggugcggggauaugcgcaaguuaucagacccagacgaacucuccuaggcgggcccgcagcgucgcuucccagucaaucauugccuacaccaugagccugggcgcagaaaauucuguggccuacuccaacaauaguaucgcuaucccaacaaacuucacuauuagcguuaccacagaaauacuucccgugucuaugacuaagaccuccgucgacuguacgauguauaucugcggagauucaacagaguguaguaaucuguugcuccaauacggcagcuuuugcacccagcugaacagagccuuaacugggauugcaguggagcaggacaaaaauacacaggaaguuuucgcgcaagugaagcagaucuauaaaaccccgccuauuaaggauuuuggagguuucaacuuuucgcagauccugccagaccccuccaaaccuucuaagaggagcuucauagaggaucuacucuuuaauaagguaacucuggcugacgccggcuucaucaaacaauacggggauugucuuggagacauugcagcccgugauuugaucugcgcucagaaguucaacggccugaccguccugcccccacucuuaacagacgaaaugauugcccaguauacgucagcacugcuugcugguaccaucacgaguggguggacauuuggcgccggagcggccuugcagauaccuuucgcuaugcaaauggcauaccgguuuaauggcauuggggugacccagaacgugcucuaugagaaucagaaacugaucgccaaccaguucaacuccgcuauuggaaagauccaagauucucuaagcuccacagccucagcacugggcaaacuccaggacgucguuaaucagaacgcgcaggcccugaauacucuugugaagcaauugagcaguaacuuuggugcuauaucuuccguacugaaugacaucuuaagccgacucgauaagguggaagccgagguccagauugacagacugaucaccgggaggcuucagucgcugcaaacguacgugacacagcaguugauucgcgcagcugagauccgggccucagcaaaccucgccgcuaccaaaaugucugaaugcguucugggacagaguaagagaguggauuucuguggcaaagguuaccaccuaauguccuuuccccaaagcgcgccacauggcgucguguuccugcacguuacuuaugugccggcccaggagaagaauuuuaccacagcuccugcaauaugccacgacgggaaagcccauuuccccagggaaggagucuuuguaucuaacggcacucacugguucgugacccagcgcaauuuuuacgagccacagauuaucacaacggauaacaccuucguuagcgggaauugugacguggucaucggaauugugaacaauacuguauaugauccccuccaaccugagcuggacuccuucaaggaagaacuugauaaauacuuuaagaaccauacaucaccagacguggauuugggcgacaucagugguauuaaugccagcgucguuaacauacagaaggaaaucgaucgacugaaugagguggcuaaaaacuuaaacgaaucucucauugaccugcaggagcuugggaaguaugagcaguacaucaaauggcccugguauauuuggcugggauucaucgcaggccuaauagccaucgugauggucaccauuaugcucugcuguaugacuuccugcuguucaugccugaaggguuguugcaguuguggcagcugcugcaaauuugacgaagaugacuccgagccuguguugaaggggguuaagcugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13002 - RNA, 4039 nt, Artificial Sequence
  SARS-CoV-2/Congo/94/2020__EPI_ISL_417947 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaguaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccagggcgugaauuguacugaagucccuguugccauccacgcagaccagcugacaccaaccuggcgcguguauagcacaggguccaacguguuucaaacuagagccggaugccucaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccugggcgcagaaaauucuguggccuacuccaacaauaguauugcuaucccaacaaacuucacuaucagcguuaccacagaaauucuucccgugucuaugacuaagaccuccgucgacuguacgauguauauaugcggagauucaacagaguguaguaaucuguugcuccaauacggcagcuuuugcacccagcugaacagagccuuaacugggaucgcaguggagcaggacaaaaauacacaggaaguuuucgcgcaagugaagcagauuuauaaaaccccgccuaucaaggauuuuggagguuucaacuuuucgcagauucugccagaccccuccaaaccuucuaagaggagcuucaucgaggauauacuauuuaauaagguaacucucgcugacgccggcuucaucaaacaauacggggauugucugggagacauugcagcccgugaucuuaucugcgcucagaaguucaacggcuugaccguccugcccccacuccugacagacgaaaugauugcccaguauacgucagcauuacuggcugguaccaucacgaguggguggacauuuggcgccggagcggcccuucagauaccuuucgcuaugcaaauggcauaccgguuuaauggcauuggggugacccagaacguguuguaugagaaucagaaacucaucgccaaccaguucaacuccgcuauuggaaagauccaagauucucugagcuccacagccucagcacuaggcaaacugcaggacgucguuaaucagaacgcgcaggcccucaauacucuggugaagcaacuuagcaguaacuuuggugcuauaucuuccguauugaaugacauccugagccgauuagauaagguggaagccgagguccagauugacagacucaucaccgggaggcugcagucgcuucaaacguacgugacacagcagcugauucgcgcagcugagauccgggccucagcaaacuuggccgcuaccaaaaugucugaaugcguucucggacagaguaagagaguggauuucuguggcaaagguuaccaccugauguccuuuccccaaagcgcgccacauggcgucguguuccuacacguuacuuaugugccggcccaggagaagaauuuuaccacagcuccugcaauaugccacgacgggaaagcccauuuccccagggaaggagucuuuguaucuaacggcacucacugguucgugacccagcgcaauuuuuacgagccacagauuaucacaacggauaacaccuucguuagcgggaauugugacguggucaucggaauugugaacaauacuguauaugauccccugcaaccugagcucgacuccuucaaggaagaacuggauaaauacuuuaagaaccauacaucaccagacguggaucuuggcgacaucagugguauuaaugccagcgucguuaacauacagaaggaaaucgaucgauugaaugagguggcuaaaaaccugaacgaaucuuuaauugaccuccaggagcuggggaaguaugagcaguacaucaaauggcccugguauauuuggcuuggauucaucgcaggccugauagccaucgugauggucaccauuaugcuaugcuguaugacuuccugcuguucaugccucaaggguuguugcaguuguggcagcugcugcaaauuugacgaagaugacuccgagccugugcugaaggggguuaaguugcacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13003 - RNA, 4039 nt, Artificial Sequence
  SARS-CoV-2/Congo/158/2020__EPI_ISL_417950 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcagccaaccgagagcauaguucgguuccccaacauuacgaaucucugcccuuuuggagagguguucaacgccacccgcuucgcgucggucuaugcauggaaucgaaagagaaucucuaacuguguggccgacuacuccguacuuuacaauucagcuaguuuuagcacauucaaaugcuauggcguuuccccaacuaagcugaacgacuuguguuuuaccaauguguacgccgauucuuucgucauuaggggugacgaagugcggcagaucgcacccgggcaaacaggaaaaaucgcugauuauaacuacaagcuaccggacgauuuuacuggcugcgucauugccuggaauagcaacaaccuggacucaaaagugggcgggaauuauaacuaccucuaucgucuguuccgcaagaguaaucuuaagccuuuugagagagauauauccaccgaaaucuaccaggcgggaagcacacccuguaacgguguugagggcuucaauugcuacuuuccacugcagucuuauggguuccaaccuaccaacggagugggcuaccagcccuauaggguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaccaggacgugaauuguacugaagucccuguugccauccacgcagaucagcugacaccaaccuggcgcguguauagcacaggcuccaacguguuucaaacuagagccgggugccucaucggagcugagcauguaaacaauucauacgaaugugacauucccaucggcgcggguauuugcgcaaguuaucagacccagacgaacucuccuaggcgggcccgcagcgucgcuucccagucaauaaucgccuacaccaugagccugggggcagaaaauucuguggccuacuccaacaauaguauugcuaucccaacaaacuucacuaucagcguuaccacagaaauucuucccgugucuaugacuaagaccuccgucgauuguacgauguauauaugcggcgacucaacagaguguaguaaucuguugcuccaauacggcagcuuuugcacccagcugaacagagccuuaacuggaaucgcaguggagcaggauaaaaauacacaggaaguuuucgcgcaagugaagcagauuuauaaaaccccgccuaucaaggacuuugggggauucaacuuuucgcagauucugccagaucccuccaaaccuucuaagaggagcuucaucgaggaccuacucuuuaauaagguaacucuggcugaugccgguuucauaaaacaauacggcgacugucuuggggauaucgcagcccgugacuugauuugcgcucagaaguucaacggacugaccguccugcccccacucuuaacagaugaaaugaucgcccaguauacgucagcacugcuugcuggcaccauuacgagugguuggacauuuggggccggcgcggccuugcagaucccuuucgcuaugcaaauggcauaccgguuuaauggaauaggcgugacccagaacgugcucuaugagaaucagaaacugauugccaaccaguucaacuccgcuaucgggaagauucaagacucucuaagcuccacagccucagcacugggaaaacuccaggacgucguuaaucagaacgcgcaggcccugaauacucuugugaagcaauugagcaguaacuuuggcgcuaucucuuccguacugaaugauauauuaagccgacucgacaagguggaagccgagguccagaucgauagacugauuaccgguaggcuucagucgcugcaaacguacgugacacagcaguugauccgcgcagcugagauucgggccucagcaaaccucgccgcuaccaaaaugucugaaugcguucuggggcagaguaagagaguggacuucuguggaaaaggcuaccaccuaauguccuuuccccaaagcgcgccacauggugucguguuccugcacguuacuuaugugccggcccaggagaagaauuuuaccacagcuccugcaaucugccacgauggcaaagcccauuuccccagggaaggggucuuuguaucuaacggaacucacugguucgugacccagcgcaauuuuuacgagccacagauaauuacaacggacaacaccuuccucagcggcaauugugauguugugaucgggaucgucaacaauacuguguaugacccccugcaaccugagcuugauuccuucaaggaagaguuggacaaauacuuuaagaaccauacaucaccagauguagaccugggagauauuaguggcaucaaugccagcguggucaacauucagaaggaaauagaccgauuaaaugagguugcuaaaaaccucaacgaaucucugaucgaccuucaggagcuggguaaguaugagcaguacauuaaauggcccugguauaucuggcuaggguucauugcaggacucaucgccauagugauggugaccaucaugcugugcuguaugacuuccugcuguucaugcuugaagggcuguugcaguugugguagcugcugcaaauuugaugaagacgauuccgagccuguccugaagggcgugaaguuacacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13004 - RNA, 4039 nt, Artificial Sequence
  SARS-CoV-2/USA/UT-00034/2020__EPI_ISL_417977 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuauuacaaaaauaacaaguccuggauggagucugaguuccguguguauagcuccgcgaauaacuguacuuuugaguacgugucacaaccuuuccugauggaccuggaaggcaagcaggguaauuuuaaaaaccucagagaguucgucuuuaagaacauugauggguacuucaaaaucuauaguaagcauaccccaauaaauuuaguuagggaccugccccagggauuuagcgcucuugagccuuugguggaucugccaaucggcauuaacaucacacgguuccagacucuacucgcccugcaccgcucuuaccuuaccccgggcgacuccucaagcggguggacagcaggagccgcugcauauuacguagguuaucugcaacccagaaccuuuuugcucaaauacaaugaaaacggcacgauuacugaugccguggacugcgcucuggauccuuuaagugagacaaaguguacccugaagucuuucacugucgaaaaagggaucuaucagacauccaauuuuagggugcagccaaccgagagcauaguucgguuccccaacauuacgaaucucugcccuuuuggagagguguucaacgccacccgcuucgcgucggucuacgcauggaaucgaaagagaaucucuaacuguguggccgacuacuccguacuuuauaauucagcuaguuuuagcacauucaaaugcuacggcguuuccccaacuaagcugaacgacuuguguuuuaccaauguguaugccgauucuuucgucauuaggggugacgaagugcggcagaucgcacccgggcaaacaggaaaaaucgcugauuacaacuauaagcuaccggacgauuuuacuggcugcgucauugccuggaauagcaacaaccuggacucaaaagugggcgggaauuacaacuaucucuaccgucuguuccgcaagaguaaucuuaagccuuuugagagagauauauccaccgaaaucuaccaggcgggaagcacacccuguaacgguguugagggcuucaauugcuauuuuccacugcagucuuacggguuccaaccuaccaacggagugggcuaucagcccuacaggguagucguguugucauuugaacuccugcaugccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggccgggacauugcugauaccacagacgccguacgagauccacaaacccuggagauccuugacauaacuccgugcuccuucgggggagugucuguuauuacacccgguacgaauaccucgaaccaggucgcuguguuguaucagggcgugaauuguacugaagucccuguugccauccacgcagaccagcugacaccaaccuggcgcguguacagcacaggguccaacguguuucaaacuagagccggaugccucaucggcgcugagcacguaaacaauucauaugaaugugauauucccaucggugcggggauuugcgcaaguuaccagacccagacgaacucuccuaggcgggcccgcagcgucgcuucccagucaauaaucgccuacaccaugagccugggcgcagaaaauucuguggccuauuccaacaauaguauugcuaucccaacaaacuucacuaucagcguuaccacagaaauucuucccgugucuaugacuaagaccuccgucgacuguacgauguacauaugcggagauucaacagaguguaguaaucuguugcuccaauauggcagcuuuugcacccagcugaacagagccuuaacugggaucgcaguggagcaggacaaaaauacacaggaaguuuucgcgcaagugaagcagauuuacaaaaccccgccuaucaaggauuuuggagguuucaacuuuucgcagauucugccagaccccuccaaaccuucuaagaggagcuucaucgaggaucuacucuuuaauaagguaacucuggcugacgccggcuucauaaaacaauauggggauugucuuggagacaucgcagcccgugauuugauuugcgcucagaaguucaacggccugaccguccugcccccacucuuaacagacgaaaugaucgcccaguacacgucagcacugcuugcugguaccauuacgaguggguggacauuuggcgccggagcggccuugcagaucccuuucgcuaugcaaauggcauaucgguuuaauggcauaggggugacccagaacgugcucuacgagaaucagaaacugauugccaaccaguucaacuccgcuaucggaaagauucaagauucucuaagcuccacagccucagcacugggcaaacuccaggacgucguuaaucagaacgcgcaggcccugaauacucuugugaagcaauugagcaguaacuuuggugcuaucucuuccguacugaaugacauauuaagccgacucgauaagguggaagccgagguccagaucgacagacugauuaccgggaggcuucagucgcugcaaacguacgugacacagcaguugauccgcgcagcugagauucgggccucagcaaaccucgccgcuaccaaaaugucugaaugcguucugggacagaguaagagaguggauuucuguggcaaagguuaucaucuaauguccuuuccccaaagcgcgccacacggcgucguguuccugcauguuacuuacgugccggcccaggagaagaauuuuaccacagcuccugcaaucugccacgacgggaaagcccacuuccccagggaaggagucuuuguaucuaacggcacucauugguucgugacccagcgcaauuuuuaugagccacagauaauuacaacggauaacaccuucguuagcgggaauugugacguggucaucggaaucgugaacaauacuguauacgauccccuccaaccugagcuggacuccuucaaggaagaacuugauaaauauuuuaagaaccacacaucaccagacguggauuugggcgacauuagugguaucaaugccagcgucguuaacauucagaaggaaauagaucgacugaaugagguggcuaaaaacuuaaacgaaucucucaucgaccugcaggagcuugggaaguacgagcaguauauuaaauggcccugguacaucuggcugggauucauugcaggccuaaucgccauagugauggucaccaucaugcucugcuguaugacuuccugcuguucaugccugaaggguuguugcaguuguggcagcugcugcaaauuugacgaagaugacuccgagccuguguugaaggggguuaagcugcauuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13005 - RNA, 4039 nt, Artificial Sequence
  SARS-CoV-2/USA/UT-00033/2020__EPI_ISL_417976 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcgggcugacagcaggagccgcugcauacuauguagguuacuugcaacccagaaccuuucuccugaaauauaaugaaaacggcacgauuacugaugccguggacugcgcuuuagauccucugagugagacaaaguguacccucaagucuuucacugucgaaaaagggaucuaccagacauccaauuuuagggugcagccaaccgagagcauaguucgguuccccaacauuacgaaucuuugcccuuuuggagagguguucaacgccacccgcuucgcgucggucuaugcauggaaucgaaagagaaucucuaacuguguggccgacuacuccguacuguacaauucagcuaguuuuagcacauucaaaugcuauggcguuuccccaacuaaguugaacgaccuauguuuuaccaauguguacgccgauucuuucgucauuaggggugacgaagugcggcagaucgcacccgggcaaacaggaaaaaucgcugauuauaacuacaagcugccggacgauuuuacuggcugcgucauugccuggaauagcaacaaccucgacucaaaagugggcgggaauuauaacuaccuguaucgucuuuuccgcaagaguaaucugaagccuuuugagagagauauauccaccgaaaucuaccaggcgggaagcacacccuguaacgguguugagggcuucaauugcuacuuuccauugcagucuuauggguuccaaccuaccaacggagugggcuaccagcccuauaggguagucgugcucucauuugaacuguuacacgccccagcaacuguuugcggucccaaaaagaguacgaaucuggugaaaaacaagugugucaauuucaacuuuaaugggcuaacaggcaccggagugcucacugagagcaacaaaaaguuccugccuuuccagcaguuuggccgggacauugcugauaccacagacgccguacgagauccacaaacccuugagaucuuggacauaacuccgugcuccuucgggggagugucuguuauuacacccgguacgaauaccucgaaccaggucgcugugcuguaccagggcgugaauuguacugaagucccuguugccauccacgcagaccagcucacaccaaccuggcgcguguauagcacaggguccaacguguuucaaacuagagccggaugccugaucggcgcugagcauguaaacaauucauacgaaugugauauucccaucggugcggggauuugcgcaaguuaucagacccagacgaacucuccuaggcgggcccgcagcgucgcuucccagucaauaaucgccuacaccaugagccuuggcgcagaaaauucuguggccuacuccaacaauaguauugcuaucccaacaaacuucacuaucagcguuaccacagaaauucugcccgugucuaugacuaagaccuccgucgacuguacgauguauauaugcggagauucaacagaguguaguaauuugcuccugcaauacggcagcuuuugcacccaguuaaacagagcccugacugggaucgcaguggagcaggacaaaaauacacaggaaguuuucgcgcaagugaagcagauuuauaaaaccccgccuaucaaggauuuuggagguuucaacuuuucgcagauucuaccagaccccuccaaaccuucuaagaggagcuucaucgaggaucuccuguuuaauaagguaacucuugcugacgccggcuucauaaaacaauacggggauuguuugggagacaucgcagcccgugaucugauuugcgcucagaaguucaacggccucaccguccugcccccauuacugacagacgaaaugaucgcccaguauacgucagcacuuuuggcugguaccauuacgaguggguggacauuuggcgccggagcggcccuccagaucccuuucgcuaugcaaauggcauaccgguuuaauggcauaggggugacccagaacgugcuguaugagaaucagaaacuaauugccaaccaguucaacuccgcuaucggaaagauucaagauucucugagcuccacagccucagcacucggcaaacugcaggacgucguuaaucagaacgcgcaggcccuuaauacuuuggugaagcaacugagcaguaacuuuggugcuaucucuuccguauuaaaugacauacucagccgacuggauaagguggaagccgagguccagaucgacagacuuauuaccgggaggcugcagucguugcaaacguacgugacacagcagcucauccgcgcagcugagauucgggccucagcaaaccuggccgcuaccaaaaugucugaaugcguucuaggacagaguaagagaguggauuucuguggcaaagguuaccaccugauguccuuuccccaaagcgcgccacauggcgucguguuccuccacguuacuuaugugccggcccaggagaagaauuuuaccacagcuccugcaaucugccacgacgggaaagcccauuuccccagggaaggagucuuuguaucuaacggcacucacugguucgugacccagcgcaauuuuuacgagccacagauaauuacaacggauaacaccuucguuagcgggaauugugacguggucaucggaaucgugaacaauacuguauaugauccccugcaaccugagcuugacuccuucaaggaagaguuggauaaauacuuuaagaaccauacaucaccagacguggaucugggcgacauuagugguaucaaugccagcgucguuaacauucagaaggaaauagaucgauuaaaugagguggcuaaaaaccucaacgaaucucugaucgaccuucaggagcuggggaaguaugagcaguacauuaaauggcccugguauaucuggcuaggauucauugcaggccucaucgccauagugauggucaccaucaugcugugcuguaugacuuccugcuguucaugcuugaaggguuguugcaguuguggcagcugcugcaaauuugacgaagaugacuccgagccugugcugaaggggguuaaguuacacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13006 - RNA, 4039 nt, Artificial Sequence
  SARS-CoV-2/USA/WI-13/2020__EPI_ISL_417516 spike protein mRNA human (1-1273)
aggagaaagcuuaccauguucguguuucugguccuccuuccccugguuagcucccagugcgugaacuugaccacaagaacucaauuaccuccagccuacacuaauucuuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuacuaucauaaaaauaacaaguccuggauggagucugaguuccguguguacagcuccgcgaauaacuguacuuuugaauaugugucacaaccuuuccugauggaccuggaaggcaagcaggguaauuuuaaaaaccucagagaguucgucuuuaagaacauugauggguacuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaucuuaccccgggcgacuccucaagcggguggacagcaggagccgcugcauacuauguagguuaccugcaacccagaaccuuuuugcucaaauauaaugaaaacggcacgauuacugaugccguggacugcgcucuggauccuuuaagugagacaaaguguacccugaagucuuucacugucgaaaaagggaucuaccagacauccaauuuuagggugcucccaaccgagagcauaguucgguuccccaacauuacgaaucuuugcccuuuuggagagguguucaacgccacccgcuucgcgucggucuaugcauggaaucgaaagagaaucucuaacuguguggccgacuacuccguacuguacaauucagcuaguuuuagcacauucaaaugcuauggcguuuccccaacuaaguugaacgaccuauguuuuaccaauguguacgccgauucuuucgucauuaggggugacgaagugcggcagaucgcacccgggcagacaggaaaaaucgcugauuauaacuacaagcugccggacgauuuuacuggcugcgucauugccuggaauagcaacaaccucgacucaaaagugggcgggaauuauaacuaccuguaucgucuuuuccgcaagaguaaucugaagccuuuugagagagauauauccaccgaaaucuaccaagcgggaagcacacccuguaacgguguugagggcuucaauugcuacuuuccauugcagucuuauggguuccagccuaccaacggagugggcuaccaacccuauaggguagucgugcucucauuugaacuguuacacgccccagcaacuguuugcggucccaaaaagaguacgaaucuggugaaaaacaagugugucaauuucaacuuuaaugggcuaacaggcaccggagugcucacugagagcaacaaaaaguuccugccuuuccagcaguuuggccgggacauugcugauaccacagacgccguacgagauccacagacccuugagaucuuggacauaacuccgugcuccuucgggggagugucuguuauuacacccgguacgaauaccucgaaccaagucgcugugcuguaccagggcgugaauuguacugaagucccuguugccauccacgcagaccagcucacaccaaccuggcgcguguauagcacaggguccaacguguuucagacuagagccggaugccugaucggcgcugagcauguaaacaauucauacgaaugugauauucccaucggugcggggauuugcgcaaguuaucaaacccagacgaacucuccuaggcgggcccgcagcgucgcuucccagucaauaaucgccuacaccaugagccuuggcgcagaaaauucuguggccuacuccaacaauaguauugcuaucccaacaaacuucacuaucagcguuaccacagaaauucugcccgugucuaugacuaagaccuccgucgacuguacgauguauauaugcggagauucaacagaguguaguaauuugcuccugcaguacggcagcuuuugcacccaauuaaacagagcccugacugggaucgcaguggagcaggacaaaaauacacaggaaguuuucgcacaggugaagcaaauuuauaaaaccccgccuaucaaggauuuuggagguuucaacuuuucgcagauucuaccagaccccuccaaaccuucuaagaggagcuucaucgaggaucuccuguuuaauaagguaacucuugcugacgccggcuucauaaaacaguacggggauuguuugggagacaucgcagcccgugaucugauuugcgcucaaaaguucaacggccucaccguccugcccccauuacugacagacgaaaugaucgcccaguauacgucagcacuuuuggcugguaccauuacgaguggguggacauuuggcgccggagcggcccuccagaucccuuucgcuaugcagauggcauaccgguuuaauggcauaggggugacccaaaacgugcuguaugagaaucagaaacuaauugccaaccaguucaacuccgcuaucggaaagauucaggauucucugagcuccacagccucagcacucggcaaacugcaagacgucguuaaucagaacgcgcaggcccuuaauacuuuggugaagcagcugagcaguaacuuuggugcuaucucuuccguauuaaaugacauacucagccgacuggauaagguggaagccgagguccaaaucgacagacuuauuaccgggaggcugcagucguugcagacguacgugacacaacagcucauccgcgcagcugagauucgggccucagcaaaccuggccgcuaccaaaaugucugaaugcguucuaggacagaguaagagaguggauuucuguggcaaagguuaccaccugauguccuuuccccagagcgcgccacauggcgucguguuccuccacguuacuuaugugccggcccaagagaagaauuuuaccacagcgccugcuaucugccacgacgggaaagcccauuuccccagggaaggagucuuuguaucuaacggcacucacugguucgugacccagcgcaauuuuuacgagccacagauaauuacaacggauaacaccuucguuagcgggaauugugacguggucaucggaaucgugaacaauacuguauaugauccccugcagccugagcuugacuccuucaaggaagaguuggauaaauacuuuaagaaccauacaucaccagacguggaucugggcgacauuagugguaucaaugccagcgucguuaacauucaaaaggaaauagaucgauuaaaugagguggcuaaaaaccucaacgaaucucugaucgaccuucaggagcuggggaaguaugagcaguacauuaaauggcccugguauaucuggcuaggauucauugcaggccucaucgccauagugauggucaccaucaugcugugcuguaugacuuccugcuguucaugcuugaaggguuguugcaguuguggcagcugcugcaaauuugacgaagaugacuccgagccugugcugaaggggguuaaguuacacuacacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13007 - RNA, 4036 nt, Artificial Sequence
  SARS-CoV-2/India/1-27/2020__EPI_ISL_413522 spike protein mRNA human (1-1272)
aggagaaagcuuaccauguucguguuucugguccuccuuccccugguuagcucccagugcgugaacuugaccacaagaacucaauuaccuccagccuacacgaauagcuucaccaggggcguauauuacccggacaagguguuucggucaaguguccugcacagcacacaggaucuauuccuccccuuuuucuccaacgugacuugguuucaugcuauccacguuucugggaccaauggaacaaaacgcuucgacaacccugugcugccauuuaaugauggugucuauuucgcaucgaccgagaagucaaacauuauacgaggcuggaucuuugggacuacacuugacagcaaaacccagagucuguugauugugaauaacgccacgaauguaguuaucaaggugugugaguuccaguuuugcaacgaucccuuccucggagucuaccauaaaaauaacaaguccuggauggagucugaguuccguguguauagcuccgcgaauaacuguacuuuugaauacgugucacaaccuuuccugauggaccuggaaggcaagcaggguaauuuuaaaaaccucagagaguucgucuuuaagaacauugauggguauuucaaaaucuacaguaagcacaccccaauaaauuuaguuagggaccugccccagggauuuagcgcucuugagccuuugguggaucugccaaucggcauuaacaucacacgguuccagacucuacucgcccugcaucgcucuuaccuuaccccgggcgacuccucaagcggguggacagcaggagccgcugcauauuacguagguuaucugcaacccagaaccuuuuugcucaaauacaaugaaaacggcacgauuacugaugccguggacugcgcucuggauccuuuaagugagacaaaguguacccugaagucuuucacugucgaaaaagggaucuaucagacauccaauuuuagggugcagccaaccgagagcauaguucgguuccccaacauuacgaaucucugcccuuuuggagagguguucaacgccacccgcuucgcgucggucuacgcauggaaucgaaagagaaucucuaacuguguggccgacuauuccguacuuuacaauucagcuaguuuuagcacauucaaaugcuacggcguuuccccaacuaagcugaacgacuuguguuuuaccaauguguaugccgauucuuucgucauuaggggugacgaagugauccagaucgcacccgggcaaacaggaaaaauugcugauuacaacuauaagcuaccggacgauuuuacuggcugcgucauagccuggaauagcaacaaccuggacucaaaagugggcgggaauuacaacuaucucuaccggcuguuccguaagaguaaucuuaagccuuuugagcgcgauaucuccaccgaaauuuaucaggcgggaagcacacccuguaacgguguugagggcuucaauugcuacuuuccacugcagucuuacggguuccaaccuaccaacggagugggcuaucagcccuacagaguagucguguugucauuugaacuccugcacgccccagcaacuguuugcggucccaaaaagaguacgaauuuagugaaaaacaagugugucaauuucaacuuuaaugggcugacaggcaccggagugcuaacugagagcaacaaaaaguuccucccuuuccagcaguuuggcagggacaucgcugauaccacagacgccguacgggauccacaaacccuggagauacuugacauuacuccgugcuccuucgggggagugucuguuaucacacccgguacgaauaccucgaaccaggucgcuguguuguaucaggacgugaauuguacugaagucccuguugccauccacgcagaucagcugacaccaaccuggcgaguguacagcacaggcuccaacguguuucaaacucgcgccgggugccucauuggagcugagcauguaaacaauucauaugaaugugacauccccauuggcgcggguauaugcgcaaguuaccagacccagacgaacucuccuagaagggcccggagcgucgcuucccagucaaucauugccuauaccaugagccugggggcagaaaauucuguggccuacuccaacaauaguaucgcuaucccaacaaacuucacuauuagcguuaccacagaaauacuucccgugucuaugacuaagaccuccgucgauuguacgauguacaucugcggcgacucaacagaguguaguaaucuguugcuccaauauggaucuuuuugcacccagcugaaccgcgccuuaacuggcauugcaguggagcaggauaaaaauacacaggaaguuuucgcgcaagugaagcagaucuacaaaaccccgccuauuaaggacuuugggggauucaacuuuucgcagauccugccagaucccuccaaaccuucuaagagaaguuucauagaggaccuacucuuuaauaagguaacucuggcugaugccgguuucaucaaacaauauggcgacugucuuggggauauugcagccagggacuugaucugcgcucagaaguucaacggacugaccguccugcccccacucuuaacagaugaaaugauugcccaguacacgucagcacugcuugcuggcaccaucacuagcgguuggacauuuggggccggcgcggccuugcagauaccuuucgcuaugcaaauggcauaucguuuuaauggaauuggcgugacccagaacgugcucuacgagaaucagaaacugaucgccaaccaguucaacuccgcuauugggaagauccaagacucucuaagcuccacagccucagcacugggaaaacuccaggacgucguuaaucagaacgcgcaggcccugaauacucuugugaagcaauugagcaguaacuuuggcgcuauaucuuccguacugaaugauaucuuaagccggcucgacaagguggaagccgagguccagauugaucgacugaucaccgguagacuucagucgcugcaaacguaugugacacagcaguugauuagggcagcugagauccgcgccucagcaaaccucgccgcuaccaaaaugucugaaugcguucuggggcagaguaagcggguggacuucuguggaaaaggcuaccaccuaauguccuuuccccaaagcgcgccacauggugucguguuccugcacguuacuuacgugccggcccaggagaagaauuuuaccacagcuccugcaauaugccacgauggcaaagcccauuuccccagagaaggggucuuuguaucuaacggaacucacugguucgugacccagaggaauuuuuaugagccacagauuaucacaacggacaacaccuucguuagcggcaauugugauguggucaucgggauugugaacaauacuguauacgacccccuccaaccugagcuggauuccuucaaggaggaacuugacaaauauuuuaagaaccauacaucaccagauguggacuugggagauaucaguggcauuaaugccagcgucguuaacauacagaaggaaaucgaccgccugaaugagguggcuaaaaacuuaaacgaaucucucauugaccugcaggagcuugguaaguacgagcaguauaucaaauggcccugguacauuuggcugggguucaucgcaggacuaauagccaucgugauggucaccauuaugcucugcuguaugacuuccugcuguucaugccugaagggcuguugcaguugugguagcugcugcaaauuugaugaagacgauuccgagccuguguugaagggcguuaagcugcacuauacaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13008 - RNA, 4021 nt, Artificial Sequence
  SARS-CoV-2/pangolin/Guangxi/P4L/2017__EPI_ISL_410538 spike protein mRNA human (1-1267)
aggagaaagcuuaccauguucguguuucuguucguccucccccuuguuagcucccagugcgugaaccugaccacaagaacuggcaucccuccaggguacacgaauagcucaaccaggggaguauauuacccggacaagguguuucggaguagcauuuugcacuuaacacaagaucuguuccuacccuuuuucuccaacgucacuugguuuaauaccauaaacuaucaggguggcuucaaaaaguuugacaauccugugcucccauucaacgaugggguuuacuuugccucuacagagaaaucgaauaucauucgcggauggaucuucggcaccacucuggacgcucgaacacagucacuucugauugugaacaaugcaaccaacgucgugaucaagguaugugaauuucaguucugcacggaucccuucuuggguguuuauuaccauaauaacaauaaaacuuggguggagaacgaauuucgugucuauagcagugccaauaacuguaccuucgaguacauaucccaaccuuuucucauggaccuggaagggaagcagggaaacuucaagaaucugagagaguuuguguucaaaaacguggauggcuacuuuaagaucuauucuaaacacacaccaauugaccucgucagggauuuaccccggggcuucgcggcucuggagccucuuguugacuugccaaucgggauuaauaucacucgcuuucagacccugcuagcccuccauagaagcuaccugacaccgggaaaccuugaauccgguuggaccacgggcgcagccgcuuauuacgugggguaucugcagcaaaggacuuucuugcucucauacaaucagaacggaacaauaaccgaugcaguagacugcagucuggaucccuuaagcgagacuaaguguacacugaaaucucucaccguggaaaagggcauuuaucagacguccaauuuucggguccagccuaccaucucaauugugcgcuucccaaacaucacaaaucuuugccccuuuggugagguuuucaacgccagcaaguucgcuaguguguacgccuggaaucgaaaaagaaucucuaacugugucgcggacuacuccgugcuguauaauagcacuucguuuucuaccuucaagugcuacgggguauccccuacaaaauugaacgaccuauguuuuacuaauguuuaugcagauucauucguggucaagggagacgaggugaggcaaauugccccaggccagaccggcgucauagcugauuacaacuauaaacugcccgacgauuuuacagggugcgugaucgccuggaacaguguuaagcaggacgcacucaccggagguaauuacggcuaucuguaccggcuuuuccguaaaagcaagcugaagccguuugaacgcgauauuuccacugagaucuaccaagcugggucuacgccuuguaacggacaggugggcuugaauugcuauuacccccucgaaagauaugguuuccacccaacaaccgggguaaacuaccagccuuuuagggucgugguucugagcuucgaguuacugaauggccccgccacugugugcggaccaaaacuaucaaccacacucgucaaggacaaaugugugaacuuuaauuucaacggccugaccgggacuggaguacuuacaacgaguaagaaacaguuuuugcccuuccaacaguucggucgggauauauccgacaccacugaugcggugcgagacccucagacacuggaaauucucgacaucaccccaugcagcuuuggcgggguuucugucaucacaccgggaacuaauaccucaaaccagguggccgugcuguaucaagaugucaauuguacggagguucccauggcaauucaugcugagcagcuuaccccugccuggcgcguguacagugcuggcgccaacguguuccagacaagagcagguugccugguaggggccgaacacgucaauaacagcuaugagugugacaucccagugggcgcuggaauuugcgcguccuaccacucuaugucgagcuugagguccguuaaucagcggucaauaaucgcauacacuaugagucucggcgccgaaaacucuguggcuuauagcaacaauuccauugccauccccaccaacuuuacaaucucagucacuaccgagauucugccugugagcaugacgaagacaucuguugauuguaccauguacauaugcggggacuccaucgaauguaguaauuuacugcuacaauauggaucuuucugcacucagcucaaccgcgcacugacagguauugccguggagcaggauaagaauacccaggagguauuugcucaagucaaacagaucuacaagacuccacccauuaaagacuucggcggguuuaacuucucucagauccuuccggauccuuccaagccaucaaaaagaaguuuuauagaagacuugcuguucaauaaggugacccucgccgaugcaggauuuaucaagcaauauggcgacugucugggugauauugcggcuagggacuuaaucugcgcccagaaauucaacgggcugacagugcuucccccuuugcucacggaugagaugauugcacaguacaccagcgcccugcuagcuggcacuaucacaucgggauggaccuucggcgccggggcagcucugcagauacccuuugccaugcaaauggcguaucguuucaauggaauuggcgucacacagaacguucucuacgaaaaucagaagcugaucgccaaccaguuuaauuccgcuauugguaaaauccaagacucucuuagcucaacugcaagugccuuggggaagcugcaggacgugguaaaccagaaugcucaggccuuaaacacccucgugaaacaacuguccucuaacuucggagcaauaagcuccguccuuaaugauauccugucacgguuggacaagguggaggcggaaguucagauugaucgacucaucacgggcagacugcagagccuacaaacauacgugacccagcagcugauuagggccgcugagauccgcgccagugcaaaccucgcugccacuaagaugucugagugcguccugggucaguccaaacggguggacuuuuguggcaagggguaucaucuuaugagcuucccacaaucggcaccucacggaguuguguuuuugcaugucaccuacguacccgcccaggagaaaaauuucacaacugcuccagcgauaugccacgagggcaaggcccacuuuccgagagaagggguguucguuucaaacggaacccauugguuuauuacacagaggaauuucuaugagccucagaucaucacgaccgauaacacuuuugugucuggcaguugugacgucgugauugguaucguaaauaacacaguguacgauccccugcaaccagaguuagacuccuucaaagaagaacucgauaaguauuucaaaaaucacaccagccccgacgucgaucugggggacauuucuggaauaaacgcaagcguugugaauauccagaaggaaauugaucgccuuaacgagguggcuaagaaucugaacgaauccccuaucgaccuacaggagcucggcaaauacgagcaguauauuaaguggccaugguacaucuggcuggguuuuauagccggcuugaucgccauuaucauggucacuauuaugcugugcuguaugacaucaugcuguaguugcuuaaaaggguguugcagcuguggaucuugcugcaaguucgacgaagaugacuccgagcccgugcucaaaggcguuaagcugcauuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13009 - RNA, 4021 nt, Artificial Sequence
  SARS-CoV-2/pangolin/Guangxi/P5L/2017__EPI_ISL_410540 spike protein mRNA human (1-1267)
aggagaaagcuuaccauguucguguuucuguucguccucccccuuguuagcucccagugcgugaaccugaccacaagaacuggcaucccuccaggguacacgaauagcucaaccaggggaguauauuacccggacaagguguuucggaguagcauuuugcacuuaacacaagaucuguuccuacccuuuuucuccaacgucacuugguuuaauaccauaaacuaucaggguggcuucaaaaaguuugacaauccugugcucccauucaacgaugggguuuacuuugccucuacagagaaaucgaauaucauucgcggauggaucuucggcaccacucuggacgcucgaacacagucacuucugauugugaacaaugcaaccaacgucgugaucaagguaugugaauuucaguucugcacggaucccuucuuggguguuuauuaccauaauaacaauaaaacuuggguggagaacgaauuucgugucuauagcagugccaauaacuguaccuucgaguacauaucccaaccuuuucucauggaccuggaagggaagcagggaaacuucaagaaucugagagaguuuguguucaaaaacguggauggcuacuuuaagaucuauucuaaacacacaccaauugaccucgucagggauuuaccccggggcuucgcggcucuggagccucuuguugacuugccaaucgggauuaauaucacucgcuuucagacccugcuagcccuccauagaagcuaccugacaccgggaaaacuugaauccgguuggaccacgggcgcagccgcuuauuacgugggguaucugcagcaaaggacuuucuugcucucauacaaccagaauggaacaauaaccgaugcaguagacugcagucuggaucccuuaagcgagacuaaguguacacugaagucucucaccguggaaaagggcauuuaucagacguccaacuuucggguccagccuaccaucucaauugugcgcuucccaaauaucacaaaccuuugccccuuuggugagguuuucaaugccagcaaauucgcuaguguguacgccuggaaccgaaagagaaucucuaauugugucgcggacuacuccgugcuguauaacagcacuucguuuucuaccuucaaaugcuacgggguauccccuacaaaguugaaugaccuauguuuuacuaacguuuaugcagauucauucguggucaaaggagacgaggugaggcaaauugccccaggccagaccggcgucauagcugauuacaauuauaagcugcccgacgauuuuacagggugcgugaucgccuggaacaguguuaaacaggacgcacucaccggagguaacuacggcuaucuguaccggcuuuuccguaagagcaagcugaaaccguuugaacgcgauauuuccacugagaucuaccaagcugggucuacgccuuguaauggacaggugggcuugaacugcuauuacccccucgaaagauaugguuuccacccaacaaccgggguaaauuaccagccuuuuagggucgugguucugagcuucgaguuacugaacggccccgccacugugugcggaccaaagcuaucaaccacacucgucaaagacaagugugugaauuuuaacuucaauggccugaccgggacuggaguacuuacaacgaguaaaaagcaguuuuugcccuuccaacaguucggucgggauauauccgacaccacugaugcggugcgagacccucagacacuggaaauucucgacaucaccccaugcagcuuuggcgggguuucugucaucacaccgggaacuaacaccucaaaucagguggccgugcuguaucaagaugucaacuguacggagguucccauggcaauucaugcugagcagcuuaccccugccuggcgcguguacagugcuggcgccaauguguuccagacaagagcagguugccugguaggggccgaacacgucaacaauagcuaugagugugacaucccagugggcgcuggaauuugcgcguccuaccacucuaugucgagcuuuagguccguuaaccagcggucaauaaucgcauacacuaugaguuugggcgccgaaaauucuguggcuuauagcaacaacuccauugccauccccaccaauuucacaaucucagucacuaccgagauucucccugugagcaugacgaagacaucuguugauuguaccauguacauaugcggggacuccaucgaauguaguaaccuguuacugcaauauggaucuuuuugcacucagcuaaaucgcgcacucacagguauugccguggagcaggauaaaaacacccaggagguauucgcucaagucaagcagaucuacaaaacuccacccauuaaggacuuuggcggguucaauuuuucucagauccugccggauccuuccaaaccaucaaagagaaguuucauagaagaccuuuuguuuaacaaggugacccuggccgaugcaggauucaucaaacaauauggcgacugucucggugauauugcggcuagggaccugaucugcgcccagaaguucaauggguuaacagugcugcccccucuuuugacggaugagaugauugcacaguacaccagcgcccuccuggcuggcacuaucacaucgggauggaccuuuggcgccggggcagcucuacagauacccuucgccaugcaaauggcguaucguuuuaacggaauuggcgucacacagaauguucuguacgaaaaccagaaacucaucgccaaucaguucaacuccgcuauugguaagauccaagacucucugagcucaacugcaagugcccuugggaaauugcaggacgugguaaaucagaacgcucaggcccugaauaccuuagugaagcaacucuccucuaacuuuggagcaauaagcuccguccugaacgauauccuuucacggcuggacaagguggaggcggaaguucagauugaucgauugaucacgggcagacuccagagccugcaaacauacgugacccagcagcuaauuagggccgcugagauccgcgccagugcaaaucuggcugccacuaaaaugucugagugcguccucggucaguccaagcggguggacuucuguggcaaaggguaucaucugaugagcuuuccacaaucggcaccucacggaguuguguuccuucaugucaccuacguacccgcccaggaaaagaacuuuacaacugcuccagcgauaugccacgagggcaaagcccacuucccgagagaagggguguuuguuucaaauggaacccauugguucauuacacagaggaacuuuuaugagccucagaucaucacgaccgauaauacuuucgugucuggcaguugugacgucgugauugguaucguaaacaauacaguguacgaucccuugcaaccagagcuggacuccuucaaggaagaguuagauaaauauuuuaagaaccacaccagccccgacgucgaucucggggacauuucuggaauaaaugcaagcguugugaacauccagaaggaaauugaucgccugaaugagguggcuaaaaaccuuaaugaaucccugaucgaccuacaggagcucggcaaguacgagcaguauauuaaauggccuugguacaucuggcuggguuucauagccggcuugaucgccauuaucauggucacuauuaugcugugcuguaugacaucaugcuguaguugcuuaaagggguguugcagcuguggaucuugcugcaaauuugacgaagaugacuccgagccagugcucaagggcguuaagcugcauuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13010 - RNA, 4021 nt, Artificial Sequence
  SARS-CoV-2/pangolin/Guangxi/P5E/2017__EPI_ISL_410541 spike protein mRNA human (1-1267)
aggagaaagcuuaccauguucguguuucuguucguccucccccuuguuagcucccagugcgugaaccugaccacaagaacuggcaucccuccaggguacacaaauucuucaaccaggggaguauauuacccggacaagguguuucggaguagcauuuugcacuuaacacaagaucuguuccuacccuuuuucuccaacgucacuugguuuaauaccauaacauaucaggguggcucuaaaaaguucgacaacccugugcucccauuuaaugaugggguuuacuucgccucgaccgagaaaucaaacaucauucgcggauggaucuuuggcacuacacuggacgcucgaacccagagccuucugauugugaauaacgcaacgaaugucgugaucaagguaugugaguuccaguuuugcacugaucccuucuuggguguuuauuaccauaacaauaacaaaaccuggguggaaaaugaguuccgugucuauaguuccgccaacaauuguacauuugaauacauaucucaaccuuuccucauggaccuggaagggaagcagggaaacuuuaagaaccugagagaguucguguuuaaaaauguggauggcuacuucaagaucuauagcaaacacacuccaauugaccucgucagggauuuaccccggggcuuugcggcucuggagccucuuguugacuugccaaucgggauuaacaucacccgcuuccagacacugcuagcccuccauagauccuaccugaccccgggaaaacuugaaucagguuggacgacuggcgcagccgcuuauuacgugggguaucugcagcaaaggacauuuuugcucaguuacaaucagaacggaaccauaacugaugcaguagacugcagccuggaucccuuaucugagacaaaguguacccugaagucccucacgguggaaaagggcauuuaucagaccucaaauuuccggguccagccuacaaucagcauugugcgcuuuccaaacaucacuaaucuuugccccuucggugagguuuuuaacgccaguaaauucgcuucuguguacgccuggaaucgaaagagaaucuccaacugugucgcggacuacagcgugcuguauaauucgaccucuuucuccacauuuaaaugcuacgggguaucaccuacuaaguugaacgaccuauguuucaccaauguuuaugcagauaguuuuguggucaaaggagacgaggugaggcaaauugccccaggccagacaggcgucauagcugauuacaacuauaagcugcccgacgauuucaccgggugcgugaucgccuggaauagcguuaaacaggacgcacucacuggagauaacuacgguuaucuguaccggcuuuuucguaaguccaagcugaaaccguucgaacgcgacauuucuacggagaucuaccaagcuggcagcacaccuuguaacggacaggugggguugaauugcuauuacccccucgaaagauauggcuuucacccaaccacugguguaaacuaccagccuuucagggucgugguucugucauuugaguuacugaaugggcccgccaccgugugcggcccaaagcuaaguacaacccucgucaaagauaagugugugaacuucaauuuuaacggacugacuggcacagggguacuuacgaccuccaaaaagcaguucuugcccuuucaacaguucggacgggacauaagcgauacuacagacgcggugcgagacccucagacccuggaaauucucgauaucacaccaugcucuuucgguggcguuucagucaucacuccggggaccaauacgaguaaccagguggccgugcuguaucaagacgucaauuguaccgagguucccauggcaauucaugcugagcagcuuacgccugccuggcgcguguacagcgcuggagccaacguguuucagacuagagcaggcugccugguaggugccgaacacgucaauaacuccuaugagugugauaucccagugggggcuggcauuugcgcgucuuaccacucgaugagcuccuucaggucaguuaaucagcggaguauaaucgcauacaccaugucuuugggagccgaaaacagcguggcuuauuccaauaacucaauugccauccccacaaacuuuacuaucagcgucaccacggagauucucccugugucuaugacaaagaccuccguugacuguacuauguacauaugcggcgauaguaucgaauguagcaaucuguuacugcaauaugggucuuucugcacacagcuaaaccgcgcacucaccggaauugccguggagcaggacaaaaauacucaggagguauuugcucaagucaagcagaucuacaaaaccccacccauuaaggauuucgguggcuuuaacuucucccagauccugccggacccuucaaaaccaaguaagaggagcuuuauagaagaucuuuuguucaauaaggugacacuggccgacgcaggguuuaucaaacaauauggagauugucucggcgacauugcggcuagagaucugaucugcgcccagaaguucaacgguuuaacggugcugcccccucuuuugaccgacgagaugauugcacaguacacuucggcccuccuggcugggacaaucaccuccggcuggacauucggagccggcgcagcucuacagauacccuuugccaugcaaauggcguaucguuucaaugggauuggagucacucagaacguucuguacgaaaaucagaaacucaucgccaaccaguuuaauucugcuauuggcaagauccaagacagccugucaaguaccgcauccgcccuugguaaauugcaggaugugguaaaccagaaugcucaggcccugaacacguuagugaagcaacucucuagcaauuucggggcaauauccucaguccugaacgacauccuuagccggcuggauaagguggaggcggaaguucagauugaccgauugaucacaggaagacuccagagucugcaaaccuacgugacucagcagcuaauuagggccgcugagauccgcgccucugcaaaccuggcugccaccaaaauguccgagugcguccucggccagagcaagcggguggauuuuugugguaaaggcuaucaucugaugucguucccacaaucagcaccucacgggguuguguuucuucaugucacauacguacccgcccaggaaaagaauuucacuaccgcuccagcgauaugccacgagggaaaagcccacuuuccgagagaaggcguguucguuucuaacgggacacauugguuuauuacgcagaggaauuucuaugagccucagaucaucaccacugacaacacauuugugaguggauccugugaugucgugauuggcaucguaaauaacaccguguacgaccccuugcaaccagagcuggauagcuucaaggaagaguuagacaaauauuucaagaaucacacuucucccgaugucgaccucggugauauuagcgggauaaacgcauccguugugaauauccagaaggaaauugaccgccugaacgagguggcuaaaaaucuuaacgaaucacugaucgaccuacaggagcucggaaaguacgagcaguauauuaaauggccuugguacaucuggcugggcuuuauagccgguuugaucgccauuaucauggucacaauuaugcugugcuguaugaccaguugcuguagcugcuuaaagggcuguugcucuuguggguccugcugcaaauucgaugaagacgauucagagccagugcucaagggaguuaagcugcauuacacgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13011 - RNA, 4015 nt, Artificial Sequence
  SARS-CoV-2/pangolin/Guangxi/P1E/2017__EPI_ISL_410539 spike protein mRNA human (1-1265)
aggagaaagcuuaccauguucguguuucuguucguccucccccuuguuagcucccagugcgugaaccugaccacaagaacuggcauccaaccuggguacaccaauucuucaacgaggggaguauauuacccagacaagguguuucggaguagcauuuugcacuuaacacaggaucuguuccuaccguuuuucuccaacgucacuugguuuaauaccauaaacuaucaggguggcuucaagaaguuugacaaucccgugcucccuuucaacgaugggguuuacuuugccucuacagagaaaucgaauaucauucgcggauggaucuucggcaccacucuggacgcucgaacacagucacuucugauugugaacaaugcaaccaacgucgugaucaagguaugugaauuucaauucugcacggauccauucuuggguguuuauuaccauaauaacaauaaaacuuggguggagaacgaauuucgugucuauagcagugccaauaacuguaccuucgaguacauaucccagcccuuucucauggaccuggaagggaagcagggaaacuucaagaaucugagagaguuuguguucaaaaacguggauggcuacuuuaagaucuauucuaaacacacaccuauugaccucgucagggauuuaccacggggcuucgcggcucuggagccccuuguugacuugccuaucgggauuaauaucacucgcuuucagacccugcuagcccuccauagaagcuaccugacaccaggaaaacuugaauccgguuggaccacgggcgcagccgcuuauuacgugggguaucugcaacagaggacuuucuugcucucauacaaccagaauggaacaauaaccgaugcaguagacugcagucuggauccguuaagcgagacuaaguguacacugaagucucucaccguggaaaagggcauuuaucagacguccaacuuucggguccaacccaccaucucaauugugcgcuucccuaauaucacaaaccuuugcccauuuggugagguuuucaaugccagcaaauucgcuaguguguacgccuggaaccgaaagagaaucucuaauugugucgcggacuacuccgugcuguauaacagcacuucguuuucuaccuucaaaugcuacgggguaucccccacaaaguugaaugaccuauguuuuacuaacguuuaugcagauucauucguggucaaaggagacgaggugaggcagauugccccuggccagaccggcgucauagcugauuacaauuauaagcugccagacgauuuuacagggugcgugaucgccuggaacaguguuaaacaagacgcacucaccggagguaacuaccuguaucggcuuuuccguaagagcaagcugaaacccuuugaacgcgauauuuccacugagaucuaccaggcuggcucuacgccguguaauggacaggugggguugaacugcuacuauccucucgaaagauacggcuuccaccccacaaccgguguaaauuaucagccauuuagggucgugguucugagcuucgaguuacugaacgggccugccacugugugcggccccaagcuaucaaccacacucgucaaagacaagugugugaauuuuaacuucaauggacugaccggcacugggguacuuacaacgaguaaaaagcaauuuuugccauuccagcaguucggacgggauauauccgacaccacugaugcggugcgagacccccagacacuggaaauucucgacaucaccccuugcagcuuugguggcguuucugucaucacaccagggacuaacaccucaaaucaaguggccgugcuguaccaggaugucaacuguacggagguuccgauggcaauucaugcugagcagcuuacccccgccuggcgcguguauagugcuggagccaauguguuccagacaagagcaggcugccugguaggugccgaacacgucaacaauagcuacgagugugacaucccugugggggcuggcauuugcgcguccuaucacucuaugucgagcuugagguccguuaaccaacggucaauaaucgcauacacuaugagucucggagccgaaaauucuguggcuuacagcaacaacuccauugccaucccaaccaauuuuacaaucucagucacuaccgagauucugcccgugagcaugacgaagacaucuguugauuguaccauguauauaugcggcgacuccaucgaauguaguaacuuacugcuacaguacgggagcuucugcacucagcucaaucgcgcacugacaggaauugccguggagcaggauaaaaacacccaagagguauuugcucaggucaagcagaucuauaaaacuccuccaauuaaggacuucgguggcuuuaauuucucucaaauccuucccgauccguccaaaccuucaaagagaaguuuuauagaagacuugcuguucaacaaggugacccucgccgaugcaggguuuaucaaacaguacggagacugucugggcgauauugcggcuagggacuuaaucugcgcccagaaguucaauggucugacagugcuuccacccuugcucacggaugagaugauugcacaguauaccagcgcccugcuagcugggacuaucacaucgggcuggaccuucggagccggcgcagcucugcaaauaccuuuugccaugcagauggcguaccguuucaacgggauuggagucacacagaauguucucuaugaaaaccagaaacugaucgccaaucaauuuaacuccgcuauuggcaagauccaggacucucuuagcucaacugcaagugccuuggguaaacugcaggacgugguaaaucagaacgcucaagccuuaaauacccucgugaagcagcuguccucuaacuucggggcaauaagcuccguccuuaacgauauccugucacgguuggacaagguggaggcggaaguucagauugaucgacucaucacgggaagacugcaaagccuacagacauacgugacccagcagcugauuagggccgcugagauccgcgccagugcaaaucucgcugccacuaaaaugucugagugcguccugggccaauccaagcggguggacuuuugugguaaaggcuaccaucuuaugagcuucccccagucggcaccacacgggguuguguuuuugcaugucaccuauguaccugcccaggaaaagaacuucacaacugcucccgcgauaugccacgagggaaaagcccacuuuccaagagaaggcguguucguuucaaaugggacccauugguuuauuacacagaggaacuucuacgagccgcaaaucaucacgaccgauaauacuuuugugucuggaaguugugacgucgugauuggcaucguaaacaauacaguguaugauccucugcagcccgaguuagacuccuucaaggaggaacucgauaaauacuucaagaaccacaccagcccagacgucgaucugggugacauuucugggauaaaugcaagcguugugaacauccagaaggaaauugaucgccuuaaugagguggcuaaaaaccugaaugaaucccuaaucgaccuccaggagcugggaaaguaugagcaauacauuaaauggcccugguauaucugguugggcuuuauagccggucugaucgccauuaucauggucacuauuauguuaugcuguaugacaucaugcuguaguugccucaagggcuguugcagcugugggucuugcugcaaauucgacgaagaugacuccgagccugugcugaagggaguuaaacuucauuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13012 - RNA, 4039 nt, Artificial Sequence
  SARS-CoV-2/Wuhan/WIV05/2019__EPI_ISL_402128 spike protein mRNA gc mod (1-1273)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13013 - RNA, 4039 nt, Artificial Sequence; identical to SEQ ID NO: 165
  SARS-CoV-2/Wuhan/WIV05/2019__EPI_ISL_402128 spike protein mRNA gc mod (1-1273)(K986P_V987P) R9519

SEQ ID NO: 13014 - RNA, 4039 nt, Artificial Sequence
  SARS-CoV-2/Wuhan/WIV05/2019__EPI_ISL_402128 spike protein mRNA gc mod (1-1273)(K986P_V987P_T887WN_A1020W)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggugguuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagauggucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13015 - RNA, 4039 nt, Artificial Sequence
  SARS-CoV-2/Wuhan/WIV05/2019__EPI_ISL_402128 spike protein mRNA gc mod (1-1273)(K986P_V987P_P1069F)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauauguguucgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13016 - RNA, 4039 nt, Artificial Sequence
  SARS-CoV-2/Wuhan/WIV05/2019__EPI_ISL_402128 spike protein mRNA gc mod (1-1273)(K986P_V987P_ H1048Q_H1064N_ H1083N_H1101N)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccagcugaugagcuucccucagucugccccucacggcgugguguuucugaacgugacauaugugcccgcucaagagaagaauuucaccaccgcuccagccaucugcaacgacggcaaagcccacuuuccuagagaaggcguguucguguccaacggcaccaacugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13017 - RNA, 4039 nt, Artificial Sequence
  SARS-CoV-2/Wuhan/WIV05/2019__EPI_ISL_402128 spike protein mRNA gc mod (1-1273)(I712C_T1077C)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuugcgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccugugcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13018 - RNA, 4039 nt, Artificial Sequence
  SARS-CoV-2/Wuhan/WIV05/2019__EPI_ISL_402128 spike protein mRNA gc mod (1-1273)(I714C_Y1110C)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuugccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucugugagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13019 - RNA, 4039 nt, Artificial Sequence
  SARS-CoV-2/Wuhan/WIV05/2019__EPI_ISL_402128 spike protein mRNA gc mod (1-1273)(P715C_P1069C)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuaucugcaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugugugcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13020 - RNA, 4039 nt, Artificial Sequence
  SARS-CoV-2/Wuhan/WIV05/2019__EPI_ISL_402128 spike protein mRNA gc mod (1-1273)(G889C_L1034C)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuugcgcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugaguguguguguggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13021 - RNA, 4039 nt, Artificial Sequence
  SARS-CoV-2/Wuhan/WIV05/2019__EPI_ISL_402128 spike protein mRNA gc mod (1-1273)(I909C_Y1047C)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcugcggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcugucaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13022 - RNA, 4039 nt, Artificial Sequence
  SARS-CoV-2/Wuhan/WIV05/2019__EPI_ISL_402128 spike protein mRNA gc mod (1-1273)(Q965C_S1003C)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagugccuguccuccaacuucggcgccaucagcucugugcugaacgauauccugagcagacuggacaaggucgaggccgaggugcagaucgacagacugaucacaggcagacugcagugucuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13023 - RNA, 4039 nt, Artificial Sequence
  SARS-CoV-2/Wuhan/WIV05/2019__EPI_ISL_402128 spike protein mRNA gc mod (1-1273)(F970C_G999C)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacugcggcgccaucagcucugugcugaacgauauccugagcagacuggacaaggucgaggccgaggugcagaucgacagacugaucacauguagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13024 - RNA, 4039 nt, Artificial Sequence
  SARS-CoV-2/Wuhan/WIV05/2019__EPI_ISL_402128 spike protein mRNA gc mod (1-1273)(A972C_R995C)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcugcaucagcucugugcugaacgauauccugagcagacuggacaaggucgaggccgaggugcagaucgacugucugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13025 - RNA, 4039 nt, Artificial Sequence
  SARS-CoV-2/Wuhan/WIV05/2019__EPI_ISL_402128 spike protein mRNA gc mod (1-1273)(A890C_V1040C)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggaugcggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaugugacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13026 - RNA, 4039 nt, Artificial Sequence
  SARS-CoV-2/Wuhan/WIV05/2019__EPI_ISL_402128 spike protein mRNA gc mod (1-1273)(T874C_S1055C)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacugcucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagugcgccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13027 - RNA, 2263 nt, Artificial Sequence; identical to SEQ ID NO: 168
  SARS-CoV-2/Wuhan/WIV05/2019__EPI_ISL_402128 spike protein mRNA gc mod (1-681) R9518

SEQ ID NO: 13028 - RNA, 4333 nt, Artificial Sequence
  SARS-CoV-2/Wuhan/WIV05/2019__EPI_ISL_402128 spike protein mRNA gc mod (1-1211) LumSynth construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13029 - RNA, 4333 nt, Artificial Sequence
  SARS-CoV-2/Wuhan/WIV05/2019__EPI_ISL_402128 spike protein mRNA gc mod (1-1211)(K986P_V987P) LumSynth construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13030 - RNA, 4333 nt, Artificial Sequence
  SARS-CoV-2/Wuhan/WIV05/2019__EPI_ISL_402128 spike protein mRNA gc mod (1-1211)(K986P_V987P_T887WN_A1020W) LumSynth construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggugguuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagauggucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13031 - RNA, 4333 nt, Artificial Sequence
  SARS-CoV-2/Wuhan/WIV05/2019__EPI_ISL_402128 spike protein mRNA gc mod (1-1211)(K986P_V987P_P1069F) LumSynth construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauauguguucgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13032 - RNA, 4333 nt, Artificial Sequence
  SARS-CoV-2/Wuhan/WIV05/2019__EPI_ISL_402128 spike protein mRNA gc mod (1-1211)(K986P_V987P_ H1048Q_H1064N_ H1083N_H1101N) LumSynth construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccagcugaugagcuucccucagucugccccucacggcgugguguuucugaacgugacauaugugcccgcucaagagaagaauuucaccaccgcuccagccaucugcaacgacggcaaagcccacuuuccuagagaaggcguguucguguccaacggcaccaacugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13033 - RNA, 4333 nt, Artificial Sequence
  SARS-CoV-2/Wuhan/WIV05/2019__EPI_ISL_402128 spike protein mRNA gc mod (1-1211)(I712C_T1077C) LumSynth construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuugcgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccugugcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13034 - RNA, 4333 nt, Artificial Sequence
  SARS-CoV-2/Wuhan/WIV05/2019__EPI_ISL_402128 spike protein mRNA gc mod (1-1211)(I714C_Y1110C) LumSynth construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuugccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucugugagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13035 - RNA, 4333 nt, Artificial Sequence
  SARS-CoV-2/Wuhan/WIV05/2019__EPI_ISL_402128 spike protein mRNA gc mod (1-1211)(P715C_P1069C) LumSynth construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuaucugcaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugugugcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13036 - RNA, 4333 nt, Artificial Sequence
  SARS-CoV-2/Wuhan/WIV05/2019__EPI_ISL_402128 spike protein mRNA gc mod (1-1211)(G889C_L1034C) LumSynth construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuugcgcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugaguguguguguggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13037 - RNA, 4333 nt, Artificial Sequence
  SARS-CoV-2/Wuhan/WIV05/2019__EPI_ISL_402128 spike protein mRNA gc mod (1-1211)(I909C_Y1047C) LumSynth construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcugcggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcugucaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13038 - RNA, 4333 nt, Artificial Sequence
  SARS-CoV-2/Wuhan/WIV05/2019__EPI_ISL_402128 spike protein mRNA gc mod (1-1211)(Q965C_S1003C) LumSynth construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagugccuguccuccaacuucggcgccaucagcucugugcugaacgauauccugagcagacuggacaaggucgaggccgaggugcagaucgacagacugaucacaggcagacugcagugucuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13039 - RNA, 4333 nt, Artificial Sequence
  SARS-CoV-2/Wuhan/WIV05/2019__EPI_ISL_402128 spike protein mRNA gc mod (1-1211)(F970C_G999C) LumSynth construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacugcggcgccaucagcucugugcugaacgauauccugagcagacuggacaaggucgaggccgaggugcagaucgacagacugaucacauguagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13040 - RNA, 4333 nt, Artificial Sequence
  SARS-CoV-2/Wuhan/WIV05/2019__EPI_ISL_402128 spike protein mRNA gc mod (1-1211)(A972C_R995C) LumSynth construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcugcaucagcucugugcugaacgauauccugagcagacuggacaaggucgaggccgaggugcagaucgacugucugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13041 - RNA, 4333 nt, Artificial Sequence
  SARS-CoV-2/Wuhan/WIV05/2019__EPI_ISL_402128 spike protein mRNA gc mod (1-1211)(A890C_V1040C) LumSynth construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggaugcggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaugugacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13042 - RNA, 4333 nt, Artificial Sequence
  SARS-CoV-2/Wuhan/WIV05/2019__EPI_ISL_402128 spike protein mRNA gc mod (1-1211)(T874C_S1055C) LumSynth construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacugcucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagugcgccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13043 - RNA, 4357 nt, Artificial Sequence
  SARS-CoV-2/Wuhan/WIV05/2019__EPI_ISL_402128 spike protein mRNA gc mod (1-1211) Ferritin construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13044 - RNA, 4357 nt, Artificial Sequence
  SARS-CoV-2/Wuhan/WIV05/2019__EPI_ISL_402128 spike protein mRNA gc mod (1-1211)(K986P_V987P) Ferritin construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13045 - RNA, 4357 nt, Artificial Sequence
  SARS-CoV-2/Wuhan/WIV05/2019__EPI_ISL_402128 spike protein mRNA gc mod (1-1211)(K986P_V987P_T887WN_A1020W) Ferritin construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggugguuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagauggucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13046 - RNA, 4357 nt, Artificial Sequence
  SARS-CoV-2/Wuhan/WIV05/2019__EPI_ISL_402128 spike protein mRNA gc mod (1-1211)(K986P_V987P_P1069F) Ferritin construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauauguguucgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13047 - RNA, 4357 nt, Artificial Sequence
  SARS-CoV-2/Wuhan/WIV05/2019__EPI_ISL_402128 spike protein mRNA gc mod (1-1211)(K986P_V987P_ H1048Q_H1064N_ H1083N_H1101N) Ferritin construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccagcugaugagcuucccucagucugccccucacggcgugguguuucugaacgugacauaugugcccgcucaagagaagaauuucaccaccgcuccagccaucugcaacgacggcaaagcccacuuuccuagagaaggcguguucguguccaacggcaccaacugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13048 - RNA, 4357 nt, Artificial Sequence
  SARS-CoV-2/Wuhan/WIV05/2019__EPI_ISL_402128 spike protein mRNA gc mod (1-1211)(I712C_T1077C) Ferritin construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuugcgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccugugcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13049 - RNA, 4357 nt, Artificial Sequence
  SARS-CoV-2/Wuhan/WIV05/2019__EPI_ISL_402128 spike protein mRNA gc mod (1-1211)(I714C_Y1110C) Ferritin construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuugccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucugugagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13050 - RNA, 4357 nt, Artificial Sequence
  SARS-CoV-2/Wuhan/WIV05/2019__EPI_ISL_402128 spike protein mRNA gc mod (1-1211)(P715C_P1069C) Ferritin construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuaucugcaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugugugcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13051 - RNA, 4357 nt, Artificial Sequence
  SARS-CoV-2/Wuhan/WIV05/2019__EPI_ISL_402128 spike protein mRNA gc mod (1-1211)(G889C_L1034C) Ferritin construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuugcgcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugaguguguguguggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13052 - RNA, 4357 nt, Artificial Sequence
  SARS-CoV-2/Wuhan/WIV05/2019__EPI_ISL_402128 spike protein mRNA gc mod (1-1211)(I909C_Y1047C) Ferritin construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcugcggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcugucaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13053 - RNA, 4357 nt, Artificial Sequence
  SARS-CoV-2/Wuhan/WIV05/2019__EPI_ISL_402128 spike protein mRNA gc mod (1-1211)(Q965C_S1003C) Ferritin construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagugccuguccuccaacuucggcgccaucagcucugugcugaacgauauccugagcagacuggacaaggucgaggccgaggugcagaucgacagacugaucacaggcagacugcagugucuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13054 - RNA, 4357 nt, Artificial Sequence
  SARS-CoV-2/Wuhan/WIV05/2019__EPI_ISL_402128 spike protein mRNA gc mod (1-1211)(F970C_G999C) Ferritin construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacugcggcgccaucagcucugugcugaacgauauccugagcagacuggacaaggucgaggccgaggugcagaucgacagacugaucacauguagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13055 - RNA, 4357 nt, Artificial Sequence
  SARS-CoV-2/Wuhan/WIV05/2019__EPI_ISL_402128 spike protein mRNA gc mod (1-1211)(A972C_R995C) Ferritin construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcugcaucagcucugugcugaacgauauccugagcagacuggacaaggucgaggccgaggugcagaucgacugucugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13056 - RNA, 4357 nt, Artificial Sequence
  SARS-CoV-2/Wuhan/WIV05/2019__EPI_ISL_402128 spike protein mRNA gc mod (1-1211)(A890C_V1040C) Ferritin construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggaugcggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaugugacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13057 - RNA, 4357 nt, Artificial Sequence
  SARS-CoV-2/Wuhan/WIV05/2019__EPI_ISL_402128 spike protein mRNA gc mod (1-1211)(T874C_S1055C) Ferritin construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacugcucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagugcgccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucaucaagcugcugaacgagcaagugaacaaagagaugcagagcagcaaccuguacaugagcaugagcagcuggugcuacacccacagccuugauggcgccggacuguuccuguuugaucacgccgccgaggaauacgagcacgccaagaagcugaucaucuuccugaacgagaacaacgugcccgugcagcugaccagcauuucugccccugagcacaaguucgagggccugacacagaucuuccagaaggccuacgaacacgagcagcacaucagcgagagcaucaacaacaucguggaccacgccauuaagagcaaggaucacgccaccuucaacuuucugcagugguacguggccgaacagcacgaggaagaggugcuguucaaggacauccuggacaagaucgagcugaucggcaacgagaaccacggccuguaucuggccgaccaguacgugaagggaaucgccaagagcagaaagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13058 - RNA, 3943 nt, Artificial Sequence
  SARS-CoV-2/Wuhan/WIV05/2019__EPI_ISL_402128 spike protein mRNA gc mod (1-1211) Foldon construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13059 - RNA, 3943 nt, Artificial Sequence
  SARS-CoV-2/Wuhan/WIV05/2019__EPI_ISL_402128 spike protein mRNA gc mod (1-1211)(K986P_V987P) Foldon construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13060 - RNA, 3943 nt, Artificial Sequence
  SARS-CoV-2/Wuhan/WIV05/2019__EPI_ISL_402128 spike protein mRNA gc mod (1-1211)(K986P_V987P_T887WN_A1020W) Foldon construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggugguuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagauggucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13061 - RNA, 3943 nt, Artificial Sequence
  SARS-CoV-2/Wuhan/WIV05/2019__EPI_ISL_402128 spike protein mRNA gc mod (1-1211)(K986P_V987P_P1069F) Foldon construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauauguguucgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13062 - RNA, 3943 nt, Artificial Sequence
  SARS-CoV-2/Wuhan/WIV05/2019__EPI_ISL_402128 spike protein mRNA gc mod (1-1211)(K986P_V987P_ H1048Q_H1064N_ H1083N_H1101N) Foldon construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccagcugaugagcuucccucagucugccccucacggcgugguguuucugaacgugacauaugugcccgcucaagagaagaauuucaccaccgcuccagccaucugcaacgacggcaaagcccacuuuccuagagaaggcguguucguguccaacggcaccaacugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13063 - RNA, 3943 nt, Artificial Sequence
  SARS-CoV-2/Wuhan/WIV05/2019__EPI_ISL_402128 spike protein mRNA gc mod (1-1211)(I712C_T1077C) Foldon construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuugcgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccugugcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13064 - RNA, 3943 nt, Artificial Sequence
  SARS-CoV-2/Wuhan/WIV05/2019__EPI_ISL_402128 spike protein mRNA gc mod (1-1211)(I714C_Y1110C) Foldon construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuugccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucugugagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13065 - RNA, 3943 nt, Artificial Sequence
  SARS-CoV-2/Wuhan/WIV05/2019__EPI_ISL_402128 spike protein mRNA gc mod (1-1211)(P715C_P1069C) Foldon construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuaucugcaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugugugcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13066 - RNA, 3943 nt, Artificial Sequence
  SARS-CoV-2/Wuhan/WIV05/2019__EPI_ISL_402128 spike protein mRNA gc mod (1-1211)(G889C_L1034C) Foldon construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuugcgcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugaguguguguguggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13067 - RNA, 3943 nt, Artificial Sequence
  SARS-CoV-2/Wuhan/WIV05/2019__EPI_ISL_402128 spike protein mRNA gc mod (1-1211)(I909C_Y1047C) Foldon construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcugcggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcugucaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13068 - RNA, 3943 nt, Artificial Sequence
  SARS-CoV-2/Wuhan/WIV05/2019__EPI_ISL_402128 spike protein mRNA gc mod (1-1211)(Q965C_S1003C) Foldon construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagugccuguccuccaacuucggcgccaucagcucugugcugaacgauauccugagcagacuggacaaggucgaggccgaggugcagaucgacagacugaucacaggcagacugcagugucuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13069 - RNA, 3943 nt, Artificial Sequence
  SARS-CoV-2/Wuhan/WIV05/2019__EPI_ISL_402128 spike protein mRNA gc mod (1-1211)(F970C_G999C) Foldon construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacugcggcgccaucagcucugugcugaacgauauccugagcagacuggacaaggucgaggccgaggugcagaucgacagacugaucacauguagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13070 - RNA, 3943 nt, Artificial Sequence
  SARS-CoV-2/Wuhan/WIV05/2019__EPI_ISL_402128 spike protein mRNA gc mod (1-1211)(A972C_R995C) Foldon construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcugcaucagcucugugcugaacgauauccugagcagacuggacaaggucgaggccgaggugcagaucgacugucugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13071 - RNA, 3943 nt, Artificial Sequence
  SARS-CoV-2/Wuhan/WIV05/2019__EPI_ISL_402128 spike protein mRNA gc mod (1-1211)(A890C_V1040C) Foldon construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggaugcggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaugugacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13072 - RNA, 3943 nt, Artificial Sequence
  SARS-CoV-2/Wuhan/WIV05/2019__EPI_ISL_402128 spike protein mRNA gc mod (1-1211)(T874C_S1055C) Foldon construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacugcucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagugcgccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggaucuggcuauauccccgaggcuccuagagauggccaggccuauguucggaaggauggcgaaugggugcugcugagcaccuuccuuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13073 - RNA, 4315 nt, Artificial Sequence
  SARS-CoV-2/Wuhan/WIV05/2019__EPI_ISL_402128 spike protein mRNA gc mod (1-1211) WhcAg construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13074 - RNA, 4315 nt, Artificial Sequence
  SARS-CoV-2/Wuhan/WIV05/2019__EPI_ISL_402128 spike protein mRNA gc mod (1-1211)(K986P_V987P) WhcAg construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13075 - RNA, 4315 nt, Artificial Sequence
  SARS-CoV-2/Wuhan/WIV05/2019__EPI_ISL_402128 spike protein mRNA gc mod (1-1211)(K986P_V987P_T887WN_A1020W) WhcAg construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggugguuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagauggucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13076 - RNA, 4315 nt, Artificial Sequence
  SARS-CoV-2/Wuhan/WIV05/2019__EPI_ISL_402128 spike protein mRNA gc mod (1-1211)(K986P_V987P_P1069F) WhcAg construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauauguguucgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13077 - RNA, 4315 nt, Artificial Sequence
  SARS-CoV-2/Wuhan/WIV05/2019__EPI_ISL_402128 spike protein mRNA gc mod (1-1211)(K986P_V987P_ H1048Q_H1064N_ H1083N_H1101N) WhcAg construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccagcugaugagcuucccucagucugccccucacggcgugguguuucugaacgugacauaugugcccgcucaagagaagaauuucaccaccgcuccagccaucugcaacgacggcaaagcccacuuuccuagagaaggcguguucguguccaacggcaccaacugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13078 - RNA, 4315 nt, Artificial Sequence
  SARS-CoV-2/Wuhan/WIV05/2019__EPI_ISL_402128 spike protein mRNA gc mod (1-1211)(I712C_T1077C) WhcAg construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuugcgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccugugcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13079 - RNA, 4315 nt, Artificial Sequence
  SARS-CoV-2/Wuhan/WIV05/2019__EPI_ISL_402128 spike protein mRNA gc mod (1-1211)(I714C_Y1110C) WhcAg construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuugccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucugugagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13080 - RNA, 4315 nt, Artificial Sequence
  SARS-CoV-2/Wuhan/WIV05/2019__EPI_ISL_402128 spike protein mRNA gc mod (1-1211)(P715C_P1069C) WhcAg construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuaucugcaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugugugcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13081 - RNA, 4315 nt, Artificial Sequence
  SARS-CoV-2/Wuhan/WIV05/2019__EPI_ISL_402128 spike protein mRNA gc mod (1-1211)(G889C_L1034C) WhcAg construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuugcgcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugaguguguguguggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13082 - RNA, 4315 nt, Artificial Sequence
  SARS-CoV-2/Wuhan/WIV05/2019__EPI_ISL_402128 spike protein mRNA gc mod (1-1211)(I909C_Y1047C) WhcAg construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcugcggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcugucaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13083 - RNA, 4315 nt, Artificial Sequence
  SARS-CoV-2/Wuhan/WIV05/2019__EPI_ISL_402128 spike protein mRNA gc mod (1-1211)(Q965C_S1003C) WhcAg construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagugccuguccuccaacuucggcgccaucagcucugugcugaacgauauccugagcagacuggacaaggucgaggccgaggugcagaucgacagacugaucacaggcagacugcagugucuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13084 - RNA, 4315 nt, Artificial Sequence
  SARS-CoV-2/Wuhan/WIV05/2019__EPI_ISL_402128 spike protein mRNA gc mod (1-1211)(F970C_G999C) WhcAg construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacugcggcgccaucagcucugugcugaacgauauccugagcagacuggacaaggucgaggccgaggugcagaucgacagacugaucacauguagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13085 - RNA, 4315 nt, Artificial Sequence
  SARS-CoV-2/Wuhan/WIV05/2019__EPI_ISL_402128 spike protein mRNA gc mod (1-1211)(A972C_R995C) WhcAg construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcugcaucagcucugugcugaacgauauccugagcagacuggacaaggucgaggccgaggugcagaucgacugucugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13086 - RNA, 4315 nt, Artificial Sequence
  SARS-CoV-2/Wuhan/WIV05/2019__EPI_ISL_402128 spike protein mRNA gc mod (1-1211)(A890C_V1040C) WhcAg construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggaugcggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaugugacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13087 - RNA, 4315 nt, Artificial Sequence
  SARS-CoV-2/Wuhan/WIV05/2019__EPI_ISL_402128 spike protein mRNA gc mod (1-1211)(T874C_S1055C) WhcAg construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacugcucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagugcgccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaagggaggcggaggaucugacaucgaccccuacaaagaguucggcagcagcuaccagcugcugaacuuccugccucuggacuucuuccccgaccugaacgcccugguggauacagccacagcucuguacgaggaagaacugaccggcagagagcacugcagcccucaccacacagccauuagacaggcccucgugugcugggacgagcugacaaaacugaucgccuggaugagcagcaacaucaccagcgagcaagugcggaccaucaucgugaaccacgugaacgauaccuggggccugaaagugcggcagagccugugguuucaccugagcugucugaccuucggccagcacaccgugcaagaguuucugguguccuucggcguguggaucagaaccccugcuccauacagaccuccaaacgcucccauccugagcacccugccugagcacacagugaucuguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13088 - RNA, 4141 nt, Artificial Sequence
  SARS-CoV-2/Wuhan/WIV05/2019__EPI_ISL_402128 spike protein mRNA gc mod (1-1147) LumSynth construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13089 - RNA, 4141 nt, Artificial Sequence
  SARS-CoV-2/Wuhan/WIV05/2019__EPI_ISL_402128 spike protein mRNA gc mod (1-1147)(K986P_V987P) LumSynth construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13090 - RNA, 4141 nt, Artificial Sequence
  SARS-CoV-2/Wuhan/WIV05/2019__EPI_ISL_402128 spike protein mRNA gc mod (1-1147)(K986P_V987P_T887WN_A1020W) LumSynth construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggugguuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagauggucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13091 - RNA, 4141 nt, Artificial Sequence
  SARS-CoV-2/Wuhan/WIV05/2019__EPI_ISL_402128 spike protein mRNA gc mod (1-1147)(K986P_V987P_P1069F) LumSynth construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauauguguucgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13092 - RNA, 4141 nt, Artificial Sequence
  SARS-CoV-2/Wuhan/WIV05/2019__EPI_ISL_402128 spike protein mRNA gc mod (1-1147)(K986P_V987P_ H1048Q_H1064N_ H1083N_H1101N) LumSynth construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccagcugaugagcuucccucagucugccccucacggcgugguguuucugaacgugacauaugugcccgcucaagagaagaauuucaccaccgcuccagccaucugcaacgacggcaaagcccacuuuccuagagaaggcguguucguguccaacggcaccaacugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13093 - RNA, 4141 nt, Artificial Sequence
  SARS-CoV-2/Wuhan/WIV05/2019__EPI_ISL_402128 spike protein mRNA gc mod (1-1147)(I712C_T1077C) LumSynth construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuugcgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccugugcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13094 - RNA, 4141 nt, Artificial Sequence
  SARS-CoV-2/Wuhan/WIV05/2019__EPI_ISL_402128 spike protein mRNA gc mod (1-1147)(I714C_Y1110C) LumSynth construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuugccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucugugagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13095 - RNA, 4141 nt, Artificial Sequence
  SARS-CoV-2/Wuhan/WIV05/2019__EPI_ISL_402128 spike protein mRNA gc mod (1-1147)(P715C_P1069C) LumSynth construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuaucugcaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugugugcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 13096 - RNA, 4141 nt, Artificial Sequence
  SARS-CoV-2/Wuhan/WIV05/2019__EPI_ISL_402128 spike protein mRNA gc mod (1-1147)(G889C_L1034C) LumSynth construct
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuugcgcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugaguguguguguggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcggcggaggaucuggcggaggacagaucuacgagggcaagcugacagccgagggccugagauuuggaaucguggccagccgguucaaucacgcccugguggauagacugguggaaggcgccaucgaugccauugucagacacggcggcagagaagaggacaucacccucguuagagugcccggcucuugggagauuccuguggcugcuggcgagcuggcccggaaagaagauaucgacgccguuaucgccaucggcgugcugaucagaggcgccacaccucacuucgacuauaucgccagcgagguguccaaaggccuggccgaucugagccuggaacugagaaagcccaucaccuucggcgugaucaccgcugacacacuggaacaggccauugagagagccggcaccaagcacggcaacaaaggaugggaagccgcucuguccgccaucgagauggccaaccuguucaagagccugcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu
